United States Patent 12,097,253 (RSV RNA MOLECULES AND COMPOSITIONS FOR VACCINATION) - sequence listing, part 2

SEQ ID NO: 1107 - RNA, 2094 nt, synthetic construct
  misc_feature 1..2094: note = mRNA product Design e-6 comprising derived and/or modified sequence from HRSV(A2)__F0_DSCav1 (opt1)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1108 - RNA, 2094 nt, synthetic construct
  misc_feature 1..2094: note = mRNA product Design e-6 comprising derived and/or modified sequence from HRSV(A2)__F0_DSCav1 (opt1)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1109 - RNA, 2094 nt, synthetic construct
  misc_feature 1..2094: note = mRNA product Design e-6 comprising derived and/or modified sequence from HRSV(A2)__F0_DSCav1 (opt2)
  source 1..2094: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1110 - RNA, 2094 nt, synthetic construct
  misc_feature 1..2094: note = mRNA product Design e-6 comprising derived and/or modified sequence from HRSV(A2)__F0_DSCav1 (opt3)
  source 1..2094: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1111 - RNA, 2094 nt, synthetic construct
  misc_feature 1..2094: note = mRNA product Design e-6 comprising derived and/or modified sequence from HRSV(A2)__F0_DSCav1 (opt4)
  source 1..2094: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1112 - RNA, 2094 nt, synthetic construct
  misc_feature 1..2094: note = mRNA product Design e-6 comprising derived and/or modified sequence from HRSV(A2)__F0_DSCav1 (opt5)
  source 1..2094: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1113 - RNA, 2094 nt, synthetic construct
  misc_feature 1..2094: note = mRNA product Design e-6 comprising derived and/or modified sequence from HRSV(A2)__F0_DSCav1 (opt6)
  source 1..2094: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1114 - RNA, 2094 nt, synthetic construct
  misc_feature 1..2094: note = mRNA product Design e-6 comprising derived and/or modified sequence from HRSV(A2)__F0_DSCav1 (opt11)
  source 1..2094: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1115 - RNA, 2310 nt, synthetic construct
  misc_feature 1..2310: note = mRNA product Design f-1 comprising derived and/or modified sequence from HRSV(A2)__F0_DSCav1 (opt1)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1116 - RNA, 2310 nt, synthetic construct
  misc_feature 1..2310: note = mRNA product Design f-1 comprising derived and/or modified sequence from HRSV(A2)__F0_DSCav1 (opt1)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1117 - RNA, 2310 nt, synthetic construct
  misc_feature 1..2310: note = mRNA product Design f-1 comprising derived and/or modified sequence from HRSV(A2)__F0_DSCav1 (opt2)
  source 1..2310: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1118 - RNA, 2310 nt, synthetic construct
  misc_feature 1..2310: note = mRNA product Design f-1 comprising derived and/or modified sequence from HRSV(A2)__F0_DSCav1 (opt3)
  source 1..2310: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1119 - RNA, 2310 nt, synthetic construct
  misc_feature 1..2310: note = mRNA product Design f-1 comprising derived and/or modified sequence from HRSV(A2)__F0_DSCav1 (opt4)
  source 1..2310: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1120 - RNA, 2310 nt, synthetic construct
  misc_feature 1..2310: note = mRNA product Design f-1 comprising derived and/or modified sequence from HRSV(A2)__F0_DSCav1 (opt5)
  source 1..2310: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1121 - RNA, 2310 nt, synthetic construct
  misc_feature 1..2310: note = mRNA product Design f-1 comprising derived and/or modified sequence from HRSV(A2)__F0_DSCav1 (opt6)
  source 1..2310: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1122 - RNA, 2310 nt, synthetic construct
  misc_feature 1..2310: note = mRNA product Design f-1 comprising derived and/or modified sequence from HRSV(A2)__F0_DSCav1 (opt11)
  source 1..2310: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1123 - RNA, 2090 nt, synthetic construct
  misc_feature 1..2090: note = mRNA product Design f-2 comprising derived and/or modified sequence from HRSV(A2)__F0_DSCav1 (opt1)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1124 - RNA, 2090 nt, synthetic construct
  misc_feature 1..2090: note = mRNA product Design f-2 comprising derived and/or modified sequence from HRSV(A2)__F0_DSCav1 (opt1)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1125 - RNA, 2090 nt, synthetic construct
  misc_feature 1..2090: note = mRNA product Design f-2 comprising derived and/or modified sequence from HRSV(A2)__F0_DSCav1 (opt2)
  source 1..2090: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1126 - RNA, 2090 nt, synthetic construct
  misc_feature 1..2090: note = mRNA product Design f-2 comprising derived and/or modified sequence from HRSV(A2)__F0_DSCav1 (opt3)
  source 1..2090: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1127 - RNA, 2090 nt, synthetic construct
  misc_feature 1..2090: note = mRNA product Design f-2 comprising derived and/or modified sequence from HRSV(A2)__F0_DSCav1 (opt4)
  source 1..2090: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1128 - RNA, 2090 nt, synthetic construct
  misc_feature 1..2090: note = mRNA product Design f-2 comprising derived and/or modified sequence from HRSV(A2)__F0_DSCav1 (opt5)
  source 1..2090: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1129 - RNA, 2090 nt, synthetic construct
  misc_feature 1..2090: note = mRNA product Design f-2 comprising derived and/or modified sequence from HRSV(A2)__F0_DSCav1 (opt6)
  source 1..2090: mol_type = other RNA
gggagagcggctcggccattttgtcccagtcagtccggaggctgcggctgcagaagtaccgcctgcggagtaactgcaaagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1130 - RNA, 2090 nt, synthetic construct
  misc_feature 1..2090: note = mRNA product Design f-2 comprising derived and/or modified sequence from HRSV(A2)__F0_DSCav1 (opt11)
  source 1..2090: mol_type = other RNA
gggagagcggctcggccattttgtcccagtcagtccggaggctgcggctgcagaagtaccgcctgcggagtaactgcaaagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1131 - RNA, 2081 nt, synthetic construct
  misc_feature 1..2081: note = mRNA product Design f-3 comprising derived and/or modified sequence from HRSV(A2)__F0_DSCav1 (opt1)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1132 - RNA, 2081 nt, synthetic construct
  misc_feature 1..2081: note = mRNA product Design f-3 comprising derived and/or modified sequence from HRSV(A2)__F0_DSCav1 (opt1)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1133 - RNA, 2081 nt, synthetic construct
  misc_feature 1..2081: note = mRNA product Design f-3 comprising derived and/or modified sequence from HRSV(A2)__F0_DSCav1 (opt2)
  source 1..2081: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1134 - RNA, 2081 nt, synthetic construct
  misc_feature 1..2081: note = mRNA product Design f-3 comprising derived and/or modified sequence from HRSV(A2)__F0_DSCav1 (opt3)
  source 1..2081: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1135 - RNA, 2081 nt, synthetic construct
  misc_feature 1..2081: note = mRNA product Design f-3 comprising derived and/or modified sequence from HRSV(A2)__F0_DSCav1 (opt4)
  source 1..2081: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1136 - RNA, 2081 nt, synthetic construct
  misc_feature 1..2081: note = mRNA product Design f-3 comprising derived and/or modified sequence from HRSV(A2)__F0_DSCav1 (opt5)
  source 1..2081: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1137 - RNA, 2081 nt, synthetic construct
  misc_feature 1..2081: note = mRNA product Design f-3 comprising derived and/or modified sequence from HRSV(A2)__F0_DSCav1 (opt6)
  source 1..2081: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1138 - RNA, 2081 nt, synthetic construct
  misc_feature 1..2081: note = mRNA product Design f-3 comprising derived and/or modified sequence from HRSV(A2)__F0_DSCav1 (opt11)
  source 1..2081: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1139 - RNA, 2297 nt, synthetic construct
  misc_feature 1..2297: note = mRNA product Design f-4 comprising derived and/or modified sequence from HRSV(A2)__F0_DSCav1 (opt1)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1140 - RNA, 2297 nt, synthetic construct
  misc_feature 1..2297: note = mRNA product Design f-4 comprising derived and/or modified sequence from HRSV(A2)__F0_DSCav1 (opt1)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1141 - RNA, 2297 nt, synthetic construct
  misc_feature 1..2297: note = mRNA product Design f-4 comprising derived and/or modified sequence from HRSV(A2)__F0_DSCav1 (opt2)
  source 1..2297: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1142 - RNA, 2297 nt, synthetic construct
  misc_feature 1..2297: note = mRNA product Design f-4 comprising derived and/or modified sequence from HRSV(A2)__F0_DSCav1 (opt3)
  source 1..2297: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1143 - RNA, 2297 nt, synthetic construct
  misc_feature 1..2297: note = mRNA product Design f-4 comprising derived and/or modified sequence from HRSV(A2)__F0_DSCav1 (opt4)
  source 1..2297: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1144 - RNA, 2297 nt, synthetic construct
  misc_feature 1..2297: note = mRNA product Design f-4 comprising derived and/or modified sequence from HRSV(A2)__F0_DSCav1 (opt5)
  source 1..2297: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1145 - RNA, 2297 nt, synthetic construct
  misc_feature 1..2297: note = mRNA product Design f-4 comprising derived and/or modified sequence from HRSV(A2)__F0_DSCav1 (opt6)
  source 1..2297: mol_type = other RNA
gggagagtcccgcagtcggcgtccagcggctctgcttgttcgtgtgtgtgtcgttgcaggccttattcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1146 - RNA, 2297 nt, synthetic construct
  misc_feature 1..2297: note = mRNA product Design f-4 comprising derived and/or modified sequence from HRSV(A2)__F0_DSCav1 (opt11)
  source 1..2297: mol_type = other RNA
gggagagtcccgcagtcggcgtccagcggctctgcttgttcgtgtgtgtgtcgttgcaggccttattcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1147 - RNA, 2073 nt, synthetic construct
  misc_feature 1..2073: note = mRNA product Design f-5 comprising derived and/or modified sequence from HRSV(A2)__F0_DSCav1 (opt1)
  source 1..2073: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1148 - RNA, 2073 nt, synthetic construct
  misc_feature 1..2073: note = mRNA product Design f-5 comprising derived and/or modified sequence from HRSV(A2)__F0_DSCav1 (opt1)
  source 1..2073: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1149 - RNA, 2073 nt, synthetic construct
  misc_feature 1..2073: note = mRNA product Design f-5 comprising derived and/or modified sequence from HRSV(A2)__F0_DSCav1 (opt2)
  source 1..2073: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1150 - RNA, 2073 nt, synthetic construct
  misc_feature 1..2073: note = mRNA product Design f-5 comprising derived and/or modified sequence from HRSV(A2)__F0_DSCav1 (opt3)
  source 1..2073: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1151 - RNA, 2073 nt, synthetic construct
  misc_feature 1..2073: note = mRNA product Design f-5 comprising derived and/or modified sequence from HRSV(A2)__F0_DSCav1 (opt4)
  source 1..2073: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1152 - RNA, 2073 nt, synthetic construct
  misc_feature 1..2073: note = mRNA product Design f-5 comprising derived and/or modified sequence from HRSV(A2)__F0_DSCav1 (opt5)
  source 1..2073: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1153 - RNA, 2073 nt, synthetic construct
  misc_feature 1..2073: note = mRNA product Design f-5 comprising derived and/or modified sequence from HRSV(A2)__F0_DSCav1 (opt6)
  source 1..2073: mol_type = other RNA
gggagactttcccattctgtagcagaatttggtgttgcctgtggtcttggtcccgcggagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1154 - RNA, 2073 nt, synthetic construct
  misc_feature 1..2073: note = mRNA product Design f-5 comprising derived and/or modified sequence from HRSV(A2)__F0_DSCav1 (opt11)
  source 1..2073: mol_type = other RNA
gggagactttcccattctgtagcagaatttggtgttgcctgtggtcttggtcccgcggagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1155 - RNA, 2069 nt, synthetic construct
  misc_feature 1..2069: note = mRNA product Design g-1 comprising derived and/or modified sequence from HRSV(A2)__F0_DSCav1 (opt1)
  source 1..2069: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1156 - RNA, 2069 nt, synthetic construct
  misc_feature 1..2069: note = mRNA product Design g-1 comprising derived and/or modified sequence from HRSV(A2)__F0_DSCav1 (opt1)
  source 1..2069: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1157 - RNA, 2069 nt, synthetic construct
  misc_feature 1..2069: note = mRNA product Design g-1 comprising derived and/or modified sequence from HRSV(A2)__F0_DSCav1 (opt2)
  source 1..2069: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1158 - RNA, 2069 nt, synthetic construct
  misc_feature 1..2069: note = mRNA product Design g-1 comprising derived and/or modified sequence from HRSV(A2)__F0_DSCav1 (opt3)
  source 1..2069: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1159 - RNA, 2069 nt, synthetic construct
  misc_feature 1..2069: note = mRNA product Design g-1 comprising derived and/or modified sequence from HRSV(A2)__F0_DSCav1 (opt4)
  source 1..2069: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1160 - RNA, 2069 nt, synthetic construct
  misc_feature 1..2069: note = mRNA product Design g-1 comprising derived and/or modified sequence from HRSV(A2)__F0_DSCav1 (opt5)
  source 1..2069: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1161 - RNA, 2069 nt, synthetic construct
  misc_feature 1..2069: note = mRNA product Design g-1 comprising derived and/or modified sequence from HRSV(A2)__F0_DSCav1 (opt6)
  source 1..2069: mol_type = other RNA
gggagactttcccattctgtagcagaatttggtgttgcctgtggtcttggtcccgcggagaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1162 - RNA, 2069 nt, synthetic construct
  misc_feature 1..2069: note = mRNA product Design g-1 comprising derived and/or modified sequence from HRSV(A2)__F0_DSCav1 (opt11)
  source 1..2069: mol_type = other RNA
gggagactttcccattctgtagcagaatttggtgttgcctgtggtcttggtcccgcggagaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1163 - RNA, 2084 nt, synthetic construct
  misc_feature 1..2084: note = mRNA product Design g-2 comprising derived and/or modified sequence from HRSV(A2)__F0_DSCav1 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1164 - RNA, 2084 nt, synthetic construct
  misc_feature 1..2084: note = mRNA product Design g-2 comprising derived and/or modified sequence from HRSV(A2)__F0_DSCav1 (opt1)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1165 - RNA, 2084 nt, synthetic construct
  misc_feature 1..2084: note = mRNA product Design g-2 comprising derived and/or modified sequence from HRSV(A2)__F0_DSCav1 (opt2)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1166 - RNA, 2084 nt, synthetic construct
  misc_feature 1..2084: note = mRNA product Design g-2 comprising derived and/or modified sequence from HRSV(A2)__F0_DSCav1 (opt3)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1167 - RNA, 2084 nt, synthetic construct
  misc_feature 1..2084: note = mRNA product Design g-2 comprising derived and/or modified sequence from HRSV(A2)__F0_DSCav1 (opt4)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1168 - RNA, 2084 nt, synthetic construct
  misc_feature 1..2084: note = mRNA product Design g-2 comprising derived and/or modified sequence from HRSV(A2)__F0_DSCav1 (opt5)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1169 - RNA, 2084 nt, synthetic construct
  misc_feature 1..2084: note = mRNA product Design g-2 comprising derived and/or modified sequence from HRSV(A2)__F0_DSCav1 (opt6)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1170 - RNA, 2084 nt, synthetic construct
  misc_feature 1..2084: note = mRNA product Design g-2 comprising derived and/or modified sequence from HRSV(A2)__F0_DSCav1 (opt11)
  source 1..2084: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1171 - RNA, 2316 nt, synthetic construct
  misc_feature 1..2316: note = mRNA product Design g-3 comprising derived and/or modified sequence from HRSV(A2)__F0_DSCav1 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1172 - RNA, 2316 nt, synthetic construct
  misc_feature 1..2316: note = mRNA product Design g-3 comprising derived and/or modified sequence from HRSV(A2)__F0_DSCav1 (opt1)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1173 - RNA, 2316 nt, synthetic construct
  misc_feature 1..2316: note = mRNA product Design g-3 comprising derived and/or modified sequence from HRSV(A2)__F0_DSCav1 (opt2)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1174 - RNA, 2316 nt, synthetic construct
  misc_feature 1..2316: note = mRNA product Design g-3 comprising derived and/or modified sequence from HRSV(A2)__F0_DSCav1 (opt3)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1175 - RNA, 2316 nt, synthetic construct
  misc_feature 1..2316: note = mRNA product Design g-3 comprising derived and/or modified sequence from HRSV(A2)__F0_DSCav1 (opt4)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1176 - RNA, 2316 nt, synthetic construct
  misc_feature 1..2316: note = mRNA product Design g-3 comprising derived and/or modified sequence from HRSV(A2)__F0_DSCav1 (opt5)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1177 - RNA, 2316 nt, synthetic construct
  misc_feature 1..2316: note = mRNA product Design g-3 comprising derived and/or modified sequence from HRSV(A2)__F0_DSCav1 (opt6)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1178 - RNA, 2316 nt, synthetic construct
  misc_feature 1..2316: note = mRNA product Design g-3 comprising derived and/or modified sequence from HRSV(A2)__F0_DSCav1 (opt11)
  source 1..2316: mol_type = other RNA
gggagagtccgctcagccaggttgcagaagcggcttagcgtgtgtcctaatcttctctctgcgtgtaggtaggcctgtgccgcaaacaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1179 - RNA, 2111 nt, synthetic construct
  misc_feature 1..2111: note = mRNA product Design g-4 comprising derived and/or modified sequence from HRSV(A2)__F0_DSCav1 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1180 - RNA, 2111 nt, synthetic construct
  misc_feature 1..2111: note = mRNA product Design g-4 comprising derived and/or modified sequence from HRSV(A2)__F0_DSCav1 (opt1)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1181 - RNA, 2111 nt, synthetic construct
  misc_feature 1..2111: note = mRNA product Design g-4 comprising derived and/or modified sequence from HRSV(A2)__F0_DSCav1 (opt2)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1182 - RNA, 2111 nt, synthetic construct
  misc_feature 1..2111: note = mRNA product Design g-4 comprising derived and/or modified sequence from HRSV(A2)__F0_DSCav1 (opt3)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1183 - RNA, 2111 nt, synthetic construct
  misc_feature 1..2111: note = mRNA product Design g-4 comprising derived and/or modified sequence from HRSV(A2)__F0_DSCav1 (opt4)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1184 - RNA, 2111 nt, synthetic construct
  misc_feature 1..2111: note = mRNA product Design g-4 comprising derived and/or modified sequence from HRSV(A2)__F0_DSCav1 (opt5)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1185 - RNA, 2111 nt, synthetic construct
  misc_feature 1..2111: note = mRNA product Design g-4 comprising derived and/or modified sequence from HRSV(A2)__F0_DSCav1 (opt6)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1186 - RNA, 2111 nt, synthetic construct
  misc_feature 1..2111: note = mRNA product Design g-4 comprising derived and/or modified sequence from HRSV(A2)__F0_DSCav1 (opt11)
  source 1..2111: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1187 - RNA, 2087 nt, synthetic construct
  misc_feature 1..2087: note = mRNA product Design g-5 comprising derived and/or modified sequence from HRSV(A2)__F0_DSCav1 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1188 - RNA, 2087 nt, synthetic construct
  misc_feature 1..2087: note = mRNA product Design g-5 comprising derived and/or modified sequence from HRSV(A2)__F0_DSCav1 (opt1)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1189 - RNA, 2087 nt, synthetic construct
  misc_feature 1..2087: note = mRNA product Design g-5 comprising derived and/or modified sequence from HRSV(A2)__F0_DSCav1 (opt2)
  source 1..2087: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1190 - RNA, 2087 nt, synthetic construct
  misc_feature 1..2087: note = mRNA product Design g-5 comprising derived and/or modified sequence from HRSV(A2)__F0_DSCav1 (opt3)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1191 - RNA, 2087 nt, synthetic construct
  misc_feature 1..2087: note = mRNA product Design g-5 comprising derived and/or modified sequence from HRSV(A2)__F0_DSCav1 (opt4)
  source 1..2087: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1192 - RNA, 2087 nt, synthetic construct
  misc_feature 1..2087: note = mRNA product Design g-5 comprising derived and/or modified sequence from HRSV(A2)__F0_DSCav1 (opt5)
  source 1..2087: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1193 - RNA, 2087 nt, synthetic construct
  misc_feature 1..2087: note = mRNA product Design g-5 comprising derived and/or modified sequence from HRSV(A2)__F0_DSCav1 (opt6)
  source 1..2087: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1194 - RNA, 2087 nt, synthetic construct
  misc_feature 1..2087: note = mRNA product Design g-5 comprising derived and/or modified sequence from HRSV(A2)__F0_DSCav1 (opt11)
  source 1..2087: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1195 - RNA, 2103 nt, synthetic construct
  misc_feature 1..2103: note = mRNA product Design h-1 comprising derived and/or modified sequence from HRSV(A2)__F0_DSCav1 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1196 - RNA, 2103 nt, synthetic construct
  misc_feature 1..2103: note = mRNA product Design h-1 comprising derived and/or modified sequence from HRSV(A2)__F0_DSCav1 (opt1)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1197 - RNA, 2103 nt, synthetic construct
  misc_feature 1..2103: note = mRNA product Design h-1 comprising derived and/or modified sequence from HRSV(A2)__F0_DSCav1 (opt2)
  source 1..2103: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1198 - RNA, 2103 nt, synthetic construct
  misc_feature 1..2103: note = mRNA product Design h-1 comprising derived and/or modified sequence from HRSV(A2)__F0_DSCav1 (opt3)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1199 - RNA, 2103 nt, synthetic construct
  misc_feature 1..2103: note = mRNA product Design h-1 comprising derived and/or modified sequence from HRSV(A2)__F0_DSCav1 (opt4)
  source 1..2103: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1200 - RNA, 2103 nt, synthetic construct
  misc_feature 1..2103: note = mRNA product Design h-1 comprising derived and/or modified sequence from HRSV(A2)__F0_DSCav1 (opt5)
  source 1..2103: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1201 - RNA, 2103 nt, synthetic construct
  misc_feature 1..2103: note = mRNA product Design h-1 comprising derived and/or modified sequence from HRSV(A2)__F0_DSCav1 (opt6)
  source 1..2103: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1202 - RNA, 2103 nt, synthetic construct
  misc_feature 1..2103: note = mRNA product Design h-1 comprising derived and/or modified sequence from HRSV(A2)__F0_DSCav1 (opt11)
  source 1..2103: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1203 - RNA, 2319 nt, synthetic construct
  misc_feature 1..2319: note = mRNA product Design h-2 comprising derived and/or modified sequence from HRSV(A2)__F0_DSCav1 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1204 - RNA, 2319 nt, synthetic construct
  misc_feature 1..2319: note = mRNA product Design h-2 comprising derived and/or modified sequence from HRSV(A2)__F0_DSCav1 (opt1)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1205 - RNA, 2319 nt, synthetic construct
  misc_feature 1..2319: note = mRNA product Design h-2 comprising derived and/or modified sequence from HRSV(A2)__F0_DSCav1 (opt2)
  source 1..2319: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1206 - RNA, 2319 nt, synthetic construct
  misc_feature 1..2319: note = mRNA product Design h-2 comprising derived and/or modified sequence from HRSV(A2)__F0_DSCav1 (opt3)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1207 - RNA, 2319 nt, synthetic construct
  misc_feature 1..2319: note = mRNA product Design h-2 comprising derived and/or modified sequence from HRSV(A2)__F0_DSCav1 (opt4)
  source 1..2319: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1208 - RNA, 2319 nt, synthetic construct
  misc_feature 1..2319: note = mRNA product Design h-2 comprising derived and/or modified sequence from HRSV(A2)__F0_DSCav1 (opt5)
  source 1..2319: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1209 - RNA, 2319 nt, synthetic construct
  misc_feature 1..2319: note = mRNA product Design h-2 comprising derived and/or modified sequence from HRSV(A2)__F0_DSCav1 (opt6)
  source 1..2319: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1210 - RNA, 2319 nt, synthetic construct
  misc_feature 1..2319: note = mRNA product Design h-2 comprising derived and/or modified sequence from HRSV(A2)__F0_DSCav1 (opt11)
  source 1..2319: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1211 - RNA, 2099 nt, synthetic construct
  misc_feature 1..2099: note = mRNA product Design h-3 comprising derived and/or modified sequence from HRSV(A2)__F0_DSCav1 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1212 - RNA, 2099 nt, synthetic construct
  misc_feature 1..2099: note = mRNA product Design h-3 comprising derived and/or modified sequence from HRSV(A2)__F0_DSCav1 (opt1)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1213 - RNA, 2099 nt, synthetic construct
  misc_feature 1..2099: note = mRNA product Design h-3 comprising derived and/or modified sequence from HRSV(A2)__F0_DSCav1 (opt2)
  source 1..2099: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1214 - RNA, 2099 nt, synthetic construct
  misc_feature 1..2099: note = mRNA product Design h-3 comprising derived and/or modified sequence from HRSV(A2)__F0_DSCav1 (opt3)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1215 - RNA, 2099 nt, synthetic construct
  misc_feature 1..2099: note = mRNA product Design h-3 comprising derived and/or modified sequence from HRSV(A2)__F0_DSCav1 (opt4)
  source 1..2099: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1216 - RNA, 2099 nt, synthetic construct
  misc_feature 1..2099: note = mRNA product Design h-3 comprising derived and/or modified sequence from HRSV(A2)__F0_DSCav1 (opt5)
  source 1..2099: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1217 - RNA, 2099 nt, synthetic construct
  misc_feature 1..2099: note = mRNA product Design h-3 comprising derived and/or modified sequence from HRSV(A2)__F0_DSCav1 (opt6)
  source 1..2099: mol_type = other RNA
gggagacccgtgacccggaagttgtacggctacgcgactttccctcccacaaaccctcgcgcccttcctttcctacttgggcccggcagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1218 - RNA, 2099 nt, synthetic construct
  misc_feature 1..2099: note = mRNA product Design h-3 comprising derived and/or modified sequence from HRSV(A2)__F0_DSCav1 (opt11)
  source 1..2099: mol_type = other RNA
gggagacccgtgacccggaagttgtacggctacgcgactttccctcccacaaaccctcgcgcccttcctttcctacttgggcccggcagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1219 - RNA, 2162 nt, synthetic construct
  misc_feature 1..2162: note = mRNA product Design h-4 comprising derived and/or modified sequence from HRSV(A2)__F0_DSCav1 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1220 - RNA, 2162 nt, synthetic construct
  misc_feature 1..2162: note = mRNA product Design h-4 comprising derived and/or modified sequence from HRSV(A2)__F0_DSCav1 (opt1)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1221 - RNA, 2162 nt, synthetic construct
  misc_feature 1..2162: note = mRNA product Design h-4 comprising derived and/or modified sequence from HRSV(A2)__F0_DSCav1 (opt2)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1222 - RNA, 2162 nt, synthetic construct
  misc_feature 1..2162: note = mRNA product Design h-4 comprising derived and/or modified sequence from HRSV(A2)__F0_DSCav1 (opt3)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1223 - RNA, 2162 nt, synthetic construct
  misc_feature 1..2162: note = mRNA product Design h-4 comprising derived and/or modified sequence from HRSV(A2)__F0_DSCav1 (opt4)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1224 - RNA, 2162 nt, synthetic construct
  misc_feature 1..2162: note = mRNA product Design h-4 comprising derived and/or modified sequence from HRSV(A2)__F0_DSCav1 (opt5)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1225 - RNA, 2162 nt, synthetic construct
  misc_feature 1..2162: note = mRNA product Design h-4 comprising derived and/or modified sequence from HRSV(A2)__F0_DSCav1 (opt6)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1226 - RNA, 2162 nt, synthetic construct
  misc_feature 1..2162: note = mRNA product Design h-4 comprising derived and/or modified sequence from HRSV(A2)__F0_DSCav1 (opt11)
  source 1..2162: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1227 - RNA, 2178 nt, synthetic construct
  misc_feature 1..2178: note = mRNA product Design h-5 comprising derived and/or modified sequence from HRSV(A2)__F0_DSCav1 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1228 - RNA, 2178 nt, synthetic construct
  misc_feature 1..2178: note = mRNA product Design h-5 comprising derived and/or modified sequence from HRSV(A2)__F0_DSCav1 (opt1)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1229 - RNA, 2178 nt, synthetic construct
  misc_feature 1..2178: note = mRNA product Design h-5 comprising derived and/or modified sequence from HRSV(A2)__F0_DSCav1 (opt2)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1230 - RNA, 2178 nt, synthetic construct
  misc_feature 1..2178: note = mRNA product Design h-5 comprising derived and/or modified sequence from HRSV(A2)__F0_DSCav1 (opt3)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1231 - RNA, 2178 nt, synthetic construct
  misc_feature 1..2178: note = mRNA product Design h-5 comprising derived and/or modified sequence from HRSV(A2)__F0_DSCav1 (opt4)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1232 - RNA, 2178 nt, synthetic construct
  misc_feature 1..2178: note = mRNA product Design h-5 comprising derived and/or modified sequence from HRSV(A2)__F0_DSCav1 (opt5)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1233 - RNA, 2178 nt, synthetic construct
  misc_feature 1..2178: note = mRNA product Design h-5 comprising derived and/or modified sequence from HRSV(A2)__F0_DSCav1 (opt6)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1234 - RNA, 2178 nt, synthetic construct
  misc_feature 1..2178: note = mRNA product Design h-5 comprising derived and/or modified sequence from HRSV(A2)__F0_DSCav1 (opt11)
  source 1..2178: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1235 - RNA, 2111 nt, synthetic construct
  misc_feature 1..2111: note = mRNA product Design i-1 comprising derived and/or modified sequence from HRSV(A2)__F0_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1236 - RNA, 2111 nt, synthetic construct
  misc_feature 1..2111: note = mRNA product Design i-1 comprising derived and/or modified sequence from HRSV(A2)__F0_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1237 - RNA, 2111 nt, synthetic construct
  misc_feature 1..2111: note = mRNA product Design i-1 comprising derived and/or modified sequence from HRSV(A2)__F0_DSCav1 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1238 - RNA, 2111 nt, synthetic construct
  misc_feature 1..2111: note = mRNA product Design i-1 comprising derived and/or modified sequence from HRSV(A2)__F0_DSCav1 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1239 - RNA, 2111 nt, synthetic construct
  misc_feature 1..2111: note = mRNA product Design i-1 comprising derived and/or modified sequence from HRSV(A2)__F0_DSCav1 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1240 - RNA, 2111 nt, synthetic construct
  misc_feature 1..2111: note = mRNA product Design i-1 comprising derived and/or modified sequence from HRSV(A2)__F0_DSCav1 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1241 - RNA, 2111 nt, synthetic construct
  misc_feature 1..2111: note = mRNA product Design i-1 comprising derived and/or modified sequence from HRSV(A2)__F0_DSCav1 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1242 - RNA, 2111 nt, synthetic construct
  misc_feature 1..2111: note = mRNA product Design i-1 comprising derived and/or modified sequence from HRSV(A2)__F0_DSCav1 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1243 - RNA, 2111 nt, synthetic construct
  misc_feature 1..2111: note = mRNA product Design i-2 comprising derived and/or modified sequence from HRSV(A2)__F0_DSCav1 (opt1)
  source 1..2111: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1244 - RNA, 2111 nt, synthetic construct
  misc_feature 1..2111: note = mRNA product Design i-2 comprising derived and/or modified sequence from HRSV(A2)__F0_DSCav1 (opt1)
  source 1..2111: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1245 - RNA, 2111 nt, synthetic construct
  misc_feature 1..2111: note = mRNA product Design i-2 comprising derived and/or modified sequence from HRSV(A2)__F0_DSCav1 (opt2)
  source 1..2111: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1246 - RNA, 2111 nt, synthetic construct
  misc_feature 1..2111: note = mRNA product Design i-2 comprising derived and/or modified sequence from HRSV(A2)__F0_DSCav1 (opt3)
  source 1..2111: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1247 - RNA, 2111 nt, synthetic construct
  misc_feature 1..2111: note = mRNA product Design i-2 comprising derived and/or modified sequence from HRSV(A2)__F0_DSCav1 (opt4)
  source 1..2111: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1248 - RNA, 2111 nt, synthetic construct
  misc_feature 1..2111: note = mRNA product Design i-2 comprising derived and/or modified sequence from HRSV(A2)__F0_DSCav1 (opt5)
  source 1..2111: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1249 - RNA, 2111 nt, synthetic construct
  misc_feature 1..2111: note = mRNA product Design i-2 comprising derived and/or modified sequence from HRSV(A2)__F0_DSCav1 (opt6)
  source 1..2111: mol_type = other RNA
gggagaggcgctgcctacggaggtggcagccatctccttctcggcatcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1250 - RNA, 2111 nt, synthetic construct
  misc_feature 1..2111: note = mRNA product Design i-2 comprising derived and/or modified sequence from HRSV(A2)__F0_DSCav1 (opt11)
  source 1..2111: mol_type = other RNA
gggagaggcgctgcctacggaggtggcagccatctccttctcggcatcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1251 - RNA, 2107 nt, synthetic construct
  misc_feature 1..2107: note = mRNA product Design i-2 comprising derived and/or modified sequence from HRSV(A2)__F0_DSCav1 (opt1)
  source 1..2107: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1252 - RNA, 2107 nt, synthetic construct
  misc_feature 1..2107: note = mRNA product Design i-2 comprising derived and/or modified sequence from HRSV(A2)__F0_DSCav1 (opt1)
  source 1..2107: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1253 - RNA, 2107 nt, synthetic construct
  misc_feature 1..2107: note = mRNA product Design i-2 comprising derived and/or modified sequence from HRSV(A2)__F0_DSCav1 (opt2)
  source 1..2107: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1254 - RNA, 2107 nt, synthetic construct
  misc_feature 1..2107: note = mRNA product Design i-2 comprising derived and/or modified sequence from HRSV(A2)__F0_DSCav1 (opt3)
  source 1..2107: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1255 - RNA, 2107 nt, synthetic construct
  misc_feature 1..2107: note = mRNA product Design i-2 comprising derived and/or modified sequence from HRSV(A2)__F0_DSCav1 (opt4)
  source 1..2107: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1256 - RNA, 2107 nt, synthetic construct
  misc_feature 1..2107: note = mRNA product Design i-2 comprising derived and/or modified sequence from HRSV(A2)__F0_DSCav1 (opt5)
  source 1..2107: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1257 - RNA, 2107 nt, synthetic construct
  misc_feature 1..2107: note = mRNA product Design i-2 comprising derived and/or modified sequence from HRSV(A2)__F0_DSCav1 (opt6)
  source 1..2107: mol_type = other RNA
ggggcgctgcctacggaggtggcagccatctccttctcggcatcaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1258 - RNA, 2107 nt, synthetic construct
  misc_feature 1..2107: note = mRNA product Design i-2 comprising derived and/or modified sequence from HRSV(A2)__F0_DSCav1 (opt11)
  source 1..2107: mol_type = other RNA
ggggcgctgcctacggaggtggcagccatctccttctcggcatcaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1259 - RNA, 1942 nt, synthetic construct
  misc_feature 1..1942: note = mRNA product Design i-3 comprising derived and/or modified sequence from HRSV(A2)__F0_DSCav1 (opt1) R6808
  source 1..1942: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1260 - RNA, 1942 nt, synthetic construct
  misc_feature 1..1942: note = mRNA product Design i-3 comprising derived and/or modified sequence from HRSV(A2)__F0_DSCav1 (opt1)
  source 1..1942: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctccacgcccgtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1261 - RNA, 1942 nt, synthetic construct
  misc_feature 1..1942: note = mRNA product Design i-3 comprising derived and/or modified sequence from HRSV(A2)__F0_DSCav1 (opt2)
  source 1..1942: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1262 - RNA, 1942 nt, synthetic construct
  misc_feature 1..1942: note = mRNA product Design i-3 comprising derived and/or modified sequence from HRSV(A2)__F0_DSCav1 (opt3)
  source 1..1942: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtctacacccgtgacgctcagcaaggaccagctgtccgggataaacaatatcgctttttcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1263 - RNA, 1942 nt, synthetic construct
  misc_feature 1..1942: note = mRNA product Design i-3 comprising derived and/or modified sequence from HRSV(A2)__F0_DSCav1 (opt4)
  source 1..1942: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1264 - RNA, 1942 nt, synthetic construct
  misc_feature 1..1942: note = mRNA product Design i-3 comprising derived and/or modified sequence from HRSV(A2)__F0_DSCav1 (opt5)
  source 1..1942: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtccacccccgtgacgcttagcaaggaccagctgtctggaattaacaatatcgctttttccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1265 - RNA, 1942 nt, synthetic construct
  misc_feature 1..1942: note = mRNA product Design i-3 comprising derived and/or modified sequence from HRSV(A2)__F0_DSCav1 (opt6)
  source 1..1942: mol_type = other RNA
gggagaaagcttaccatggaattattaatcctcaaagcgaacgctattactaccattctaacagcagtcacattctgcttcgcctcaggccaaaacattacagaagaattttaccaatcaacatgctctgccgtatcaaaaggctacctatccgccctacgaacaggctggtacacaagcgtaataacaatcgaactatcaaacataaaagaaaacaaatgcaacggtacagacgccaaagttaaactaataaaacaagaactcgataaatacaaaaacgcagtaacagaattacaactactaatgcaatcaacacctgcaacaaacaatagagccaggagagaattacctcgattcatgaattacacactcaataacgcaaaaaaaaccaacgttacactatcaaaaaaaagaaaacgacgattcttaggattcctactcggagtcggatcagcaatagcatctggcgttgcagtatgcaaagtattacacttagaaggtgaagtcaataaaataaaaagcgcgctactaagtacaaacaaagcagtcgtctccctatcaaacggagtctcagtcctaacattcaaagtactcgacctaaaaaattacatagataaacaactacttccaatattaaacaaacaatcctgtagcatcagcaatatagaaacagtaatagaatttcaacaaaaaaacaaccgattattagaaatcactcgagaattttccgtaaacgccggggtaacaactccagtctcaacctacatgctaaccaattcagaactattgagcttaataaacgacatgccaataaccaacgaccaaaaaaaactaatgtctaacaatgttcaaatcgtcagacaacaaagttacagtataatgtgtataatcaaagaagaagtcctagcatacgtagtccaactcccactatatggagttatcgacacaccatgttggaaattacacacctcaccattatgcacaaccaatacaaaagaaggatcaaacatatgccttacacggacagaccgcggatggtattgtgacaacgctggctcagtctcctttttcccacaagcagaaacatgcaaagtacaatcaaacagagtcttttgcgataccatgaactcacttacattaccaagcgaagtaaatctttgtaacgtcgacatcttcaatcctaaatatgactgcaaaatcatgacctcaaaaacagacgttagctcttcagtaatcactagcttaggagcaatcgtatcatgctacggcaaaacaaaatgtacagcatcaaataaaaacagaggaatcataaaaacattttcaaacggatgcgattatgtaagcaacaaaggagtagatactgtaagcgtaggaaacacattgtactatgtaaacaaacaagaaggaaaatcactctatgtaaaaggagaacctataatcaatttctacgatccattagtgttcccatcagatgaatttgacgcctcaatatcacaagttaatgaaaaaataaatcaatcgctagcattcatacgtaaatcagatgaattactacataacgtaaacgcaggcaaatccacaacaaatatcatgatcacaacaattataatagtaataatagtaatactactatcactaatagccgtaggactcctactatactgcaaagcaagatctactccagtaaccctctcaaaagatcaactaagcggaattaataacatcgcattcagcaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1266 - RNA, 1942 nt, synthetic construct
  misc_feature 1..1942: note = mRNA product Design i-3 comprising derived and/or modified sequence from HRSV(A2)__F0_DSCav1 (opt11)
  source 1..1942: mol_type = other RNA
gggagaaagcttaccatggaactacttatcctcaaagccaacgccatcaccaccatcctcacagcagtaaccttttgcttcgcctcaggccaaaatatcacagaagaattttaccagagtacctgctccgccgtatccaaaggatacctcagcgcgctccgcaccggctggtacacttcagtaatcacaatcgaactatccaacatcaaagaaaacaaatgcaacggcaccgacgcgaaagtcaaactcatcaaacaagaactagacaaatacaaaaatgccgtaacagaactacaactgttaatgcagagcacacccgccaccaacaaccgcgcccgccgggaactcccccgattcatgaactacacactcaacaacgccaaaaagacgaacgtcaccctcagcaagaaacgaaaacgcagattcctcggtttcctactaggcgtaggctcagcaatagcctccggagtagccgtctgcaaagtcctgcacttagaaggcgaagtcaacaaaatcaaatccgccctactctccacgaacaaagccgtcgtctccctgtccaacggtgtctccgttttaaccttcaaagttctggacctcaaaaactacatagacaaacagcttctccccatcctcaacaaacaatcctgtagcatctccaacatcgaaaccgtcatagaatttcaacagaaaaacaacagactgctcgaaatcacccgcgagttctccgtcaacgccggcgtcacgactcccgtctccacctatatgctcacgaactcggaactcctttccctaatcaacgacatgccgatcaccaacgaccaaaagaaactcatgtcaaacaacgtacaaattgtccgccaacaatcatactccatcatgtgcataattaaagaagaagtcctcgcatacgtagtccaactccccctctacggcgtcatcgacaccccctgctggaaactccacacctccccactctgcacaaccaacaccaaagaaggctcaaacatatgcctaacgcgcaccgatcgcggttggtactgcgacaacgccggttccgtcagcttcttcccccaagcagagacatgcaaagtccaatcaaaccgcgtcttctgcgacaccatgaactcactaacccttccaagcgaagtcaacctctgcaacgttgacatcttcaaccccaaatacgactgtaaaatcatgacctccaagaccgacgtatcctcttccgtcatcacatccctaggcgctatcgtatcctgctatggtaaaaccaaatgcaccgcctccaacaaaaaccgcggcatcatcaagacattttccaacggctgcgactacgtgagcaacaaaggcgtcgacaccgtctccgtaggcaacaccctctactatgtaaacaaacaagagggcaaatcactctacgtcaaaggggaacccatcatcaacttctacgacccgctcgtattccccagcgatgagttcgacgcctccatctcccaggtcaacgaaaagataaaccaatcactcgcattcattcgtaaatccgacgaactcctacacaacgtgaatgcaggcaaatcgaccactaacatcatgatcaccaccatcatcatcgtcatcatagtcatcctcctgtcccttatcgccgtcggtcttttattatactgcaaagcccgcagcacccccgtcaccctctctaaggaccaactcagcggcatcaataacatcgcattctctaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1267 - protein, 553 aa, synthetic construct
  REGION 1..553: note = derived and/or modified protein sequence (artificial) from HRSV(A2)__F-del_DSCav1
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 1268 - RNA, 1662 nt, synthetic construct
  misc_feature 1..1662: note = derived and/or modified CDS sequence (opt1) from HRSV(A2)__F-del_DSCav1
  source 1..1662: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 1269 - RNA, 1662 nt, synthetic construct
  misc_feature 1..1662: note = derived and/or modified CDS sequence (opt1) from HRSV(A2)__F-del_DSCav1
  source 1..1662: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctga

SEQ ID NO: 1270 - RNA, 1662 nt, synthetic construct
  misc_feature 1..1662: note = derived and/or modified CDS sequence (opt2) from HRSV(A2)__F-del_DSCav1
  source 1..1662: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 1271 - RNA, 1662 nt, synthetic construct
  misc_feature 1..1662: note = derived and/or modified CDS sequence (opt3) from HRSV(A2)__F-del_DSCav1
  source 1..1662: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtga

SEQ ID NO: 1272 - RNA, 1662 nt, synthetic construct
  misc_feature 1..1662: note = derived and/or modified CDS sequence (opt4) from HRSV(A2)__F-del_DSCav1
  source 1..1662: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 1273 - RNA, 1662 nt, synthetic construct
  misc_feature 1..1662: note = derived and/or modified CDS sequence (opt5) from HRSV(A2)__F-del_DSCav1
  source 1..1662: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtga

SEQ ID NO: 1274 - RNA, 1662 nt, synthetic construct
  misc_feature 1..1662: note = derived and/or modified CDS sequence (opt6) from HRSV(A2)__F-del_DSCav1
  source 1..1662: mol_type = other RNA
atggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaa

SEQ ID NO: 1275 - RNA, 1662 nt, synthetic construct
  misc_feature 1..1662: note = derived and/or modified CDS sequence (opt11) from HRSV(A2)__F-del_DSCav1
  source 1..1662: mol_type = other RNA
atggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtga

SEQ ID NO: 1276 - RNA, 1938 nt, synthetic construct
  misc_feature 1..1938: note = mRNA product Design a-1 comprising derived and/or modified sequence from HRSV(A2)__F-del_DSCav1 (opt1)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1277 - RNA, 1938 nt, synthetic construct
  misc_feature 1..1938: note = mRNA product Design a-1 comprising derived and/or modified sequence from HRSV(A2)__F-del_DSCav1 (opt1)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1278 - RNA, 1938 nt, synthetic construct
  misc_feature 1..1938: note = mRNA product Design a-1 comprising derived and/or modified sequence from HRSV(A2)__F-del_DSCav1 (opt2)
  source 1..1938: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1279 - RNA, 1938 nt, synthetic construct
  misc_feature 1..1938: note = mRNA product Design a-1 comprising derived and/or modified sequence from HRSV(A2)__F-del_DSCav1 (opt3)
  source 1..1938: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1280 - RNA, 1938 nt, synthetic construct
  misc_feature 1..1938: note = mRNA product Design a-1 comprising derived and/or modified sequence from HRSV(A2)__F-del_DSCav1 (opt4)
  source 1..1938: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1281 - RNA, 1938 nt, synthetic construct
  misc_feature 1..1938: note = mRNA product Design a-1 comprising derived and/or modified sequence from HRSV(A2)__F-del_DSCav1 (opt5)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1282 - RNA, 1938 nt, synthetic construct
  misc_feature 1..1938: note = mRNA product Design a-1 comprising derived and/or modified sequence from HRSV(A2)__F-del_DSCav1 (opt6)
  source 1..1938: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1283 - RNA, 1938 nt, synthetic construct
  misc_feature 1..1938: note = mRNA product Design a-1 comprising derived and/or modified sequence from HRSV(A2)__F-del_DSCav1 (opt11)
  source 1..1938: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1284 - RNA, 1957 nt, synthetic construct
  misc_feature 1..1957: note = mRNA product Design a-2 comprising derived and/or modified sequence from HRSV(A2)__F-del_DSCav1 (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1285 - RNA, 1957 nt, synthetic construct
  misc_feature 1..1957: note = mRNA product Design a-2 comprising derived and/or modified sequence from HRSV(A2)__F-del_DSCav1 (opt1)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1286 - RNA, 1957 nt, synthetic construct
  misc_feature 1..1957: note = mRNA product Design a-2 comprising derived and/or modified sequence from HRSV(A2)__F-del_DSCav1 (opt2)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1287 - RNA, 1957 nt, synthetic construct
  misc_feature 1..1957: note = mRNA product Design a-2 comprising derived and/or modified sequence from HRSV(A2)__F-del_DSCav1 (opt3)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1288 - RNA, 1957 nt, synthetic construct
  misc_feature 1..1957: note = mRNA product Design a-2 comprising derived and/or modified sequence from HRSV(A2)__F-del_DSCav1 (opt4)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1289 - RNA, 1957 nt, synthetic construct
  misc_feature 1..1957: note = mRNA product Design a-2 comprising derived and/or modified sequence from HRSV(A2)__F-del_DSCav1 (opt5)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1290 - RNA, 1957 nt, synthetic construct
  misc_feature 1..1957: note = mRNA product Design a-2 comprising derived and/or modified sequence from HRSV(A2)__F-del_DSCav1 (opt6)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1291 - RNA, 1957 nt, synthetic construct
  misc_feature 1..1957: note = mRNA product Design a-2 comprising derived and/or modified sequence from HRSV(A2)__F-del_DSCav1 (opt11)
  source 1..1957: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1292 - RNA, 2035 nt, synthetic construct
  misc_feature 1..2035: note = mRNA product Design a-3 comprising derived and/or modified sequence from HRSV(A2)__F-del_DSCav1 (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1293 - RNA, 2035 nt, synthetic construct
  misc_feature 1..2035: note = mRNA product Design a-3 comprising derived and/or modified sequence from HRSV(A2)__F-del_DSCav1 (opt1)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1294 - RNA, 2035 nt, synthetic construct
  misc_feature 1..2035: note = mRNA product Design a-3 comprising derived and/or modified sequence from HRSV(A2)__F-del_DSCav1 (opt2)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1295 - RNA, 2035 nt, synthetic construct
  misc_feature 1..2035: note = mRNA product Design a-3 comprising derived and/or modified sequence from HRSV(A2)__F-del_DSCav1 (opt3)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1296 - RNA, 2035 nt, synthetic construct
  misc_feature 1..2035: note = mRNA product Design a-3 comprising derived and/or modified sequence from HRSV(A2)__F-del_DSCav1 (opt4)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1297 - RNA, 2035 nt, synthetic construct
  misc_feature 1..2035: note = mRNA product Design a-3 comprising derived and/or modified sequence from HRSV(A2)__F-del_DSCav1 (opt5)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1298 - RNA, 2035 nt, synthetic construct
  misc_feature 1..2035: note = mRNA product Design a-3 comprising derived and/or modified sequence from HRSV(A2)__F-del_DSCav1 (opt6)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1299 - RNA, 2035 nt, synthetic construct
  misc_feature 1..2035: note = mRNA product Design a-3 comprising derived and/or modified sequence from HRSV(A2)__F-del_DSCav1 (opt11)
  source 1..2035: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1300 - RNA, 1984 nt, synthetic construct
  misc_feature 1..1984: note = mRNA product Design a-4 comprising derived and/or modified sequence from HRSV(A2)__F-del_DSCav1 (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1301 - RNA, 1984 nt, synthetic construct
  misc_feature 1..1984: note = mRNA product Design a-4 comprising derived and/or modified sequence from HRSV(A2)__F-del_DSCav1 (opt1)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1302 - RNA, 1984 nt, synthetic construct
  misc_feature 1..1984: note = mRNA product Design a-4 comprising derived and/or modified sequence from HRSV(A2)__F-del_DSCav1 (opt2)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1303 - RNA, 1984 nt, synthetic construct
  misc_feature 1..1984: note = mRNA product Design a-4 comprising derived and/or modified sequence from HRSV(A2)__F-del_DSCav1 (opt3)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1304 - RNA, 1984 nt, synthetic construct
  misc_feature 1..1984: note = mRNA product Design a-4 comprising derived and/or modified sequence from HRSV(A2)__F-del_DSCav1 (opt4)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1305 - RNA, 1984 nt, synthetic construct
  misc_feature 1..1984: note = mRNA product Design a-4 comprising derived and/or modified sequence from HRSV(A2)__F-del_DSCav1 (opt5)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1306 - RNA, 1984 nt, synthetic construct
  misc_feature 1..1984: note = mRNA product Design a-4 comprising derived and/or modified sequence from HRSV(A2)__F-del_DSCav1 (opt6)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1307 - RNA, 1984 nt, synthetic construct
  misc_feature 1..1984: note = mRNA product Design a-4 comprising derived and/or modified sequence from HRSV(A2)__F-del_DSCav1 (opt11)
  source 1..1984: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1308 - RNA, 1930 nt, synthetic construct
  misc_feature 1..1930: note = mRNA product Design a-5 comprising derived and/or modified sequence from HRSV(A2)__F-del_DSCav1 (opt1)
  source 1..1930: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1309 - RNA, 1930 nt, synthetic construct
  misc_feature 1..1930: note = mRNA product Design a-5 comprising derived and/or modified sequence from HRSV(A2)__F-del_DSCav1 (opt1)
  source 1..1930: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1310 - RNA, 1930 nt, synthetic construct
  misc_feature 1..1930: note = mRNA product Design a-5 comprising derived and/or modified sequence from HRSV(A2)__F-del_DSCav1 (opt2)
  source 1..1930: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1311 - RNA, 1930 nt, synthetic construct
  misc_feature 1..1930: note = mRNA product Design a-5 comprising derived and/or modified sequence from HRSV(A2)__F-del_DSCav1 (opt3)
  source 1..1930: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1312 - RNA, 1930 nt, synthetic construct
  misc_feature 1..1930: note = mRNA product Design a-5 comprising derived and/or modified sequence from HRSV(A2)__F-del_DSCav1 (opt4)
  source 1..1930: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1313 - RNA, 1930 nt, synthetic construct
  misc_feature 1..1930: note = mRNA product Design a-5 comprising derived and/or modified sequence from HRSV(A2)__F-del_DSCav1 (opt5)
  source 1..1930: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1314 - RNA, 1930 nt, synthetic construct
  misc_feature 1..1930: note = mRNA product Design a-5 comprising derived and/or modified sequence from HRSV(A2)__F-del_DSCav1 (opt6)
  source 1..1930: mol_type = other RNA
gggagactttcccattctgtagcagaatttggtgttgcctgtggtcttggtcccgcggagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1315 - RNA, 1930 nt, synthetic construct
  misc_feature 1..1930: note = mRNA product Design a-5 comprising derived and/or modified sequence from HRSV(A2)__F-del_DSCav1 (opt11)
  source 1..1930: mol_type = other RNA
gggagactttcccattctgtagcagaatttggtgttgcctgtggtcttggtcccgcggagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1316 - RNA, 2111 nt, synthetic construct
  misc_feature 1..2111: note = mRNA product Design b-1 comprising derived and/or modified sequence from HRSV(A2)__F-del_DSCav1 (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1317 - RNA, 2111 nt, synthetic construct
  misc_feature 1..2111: note = mRNA product Design b-1 comprising derived and/or modified sequence from HRSV(A2)__F-del_DSCav1 (opt1)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1318 - RNA, 2111 nt, synthetic construct
  misc_feature 1..2111: note = mRNA product Design b-1 comprising derived and/or modified sequence from HRSV(A2)__F-del_DSCav1 (opt2)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1319 - RNA, 2111 nt, synthetic construct
  misc_feature 1..2111: note = mRNA product Design b-1 comprising derived and/or modified sequence from HRSV(A2)__F-del_DSCav1 (opt3)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1320 - RNA, 2111 nt, synthetic construct
  misc_feature 1..2111: note = mRNA product Design b-1 comprising derived and/or modified sequence from HRSV(A2)__F-del_DSCav1 (opt4)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1321 - RNA, 2111 nt, synthetic construct
  misc_feature 1..2111: note = mRNA product Design b-1 comprising derived and/or modified sequence from HRSV(A2)__F-del_DSCav1 (opt5)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1322 - RNA, 2111 nt, synthetic construct
  misc_feature 1..2111: note = mRNA product Design b-1 comprising derived and/or modified sequence from HRSV(A2)__F-del_DSCav1 (opt6)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1323 - RNA, 2111 nt, synthetic construct
  misc_feature 1..2111: note = mRNA product Design b-1 comprising derived and/or modified sequence from HRSV(A2)__F-del_DSCav1 (opt11)
  source 1..2111: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1324 - RNA, 1931 nt, synthetic construct
  misc_feature 1..1931: note = mRNA product Design b-2 comprising derived and/or modified sequence from HRSV(A2)__F-del_DSCav1 (opt1)
  source 1..1931: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1325 - RNA, 1931 nt, synthetic construct
  misc_feature 1..1931: note = mRNA product Design b-2 comprising derived and/or modified sequence from HRSV(A2)__F-del_DSCav1 (opt1)
  source 1..1931: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1326 - RNA, 1931 nt, synthetic construct
  misc_feature 1..1931: note = mRNA product Design b-2 comprising derived and/or modified sequence from HRSV(A2)__F-del_DSCav1 (opt2)
  source 1..1931: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1327 - RNA, 1931 nt, synthetic construct
  misc_feature 1..1931: note = mRNA product Design b-2 comprising derived and/or modified sequence from HRSV(A2)__F-del_DSCav1 (opt3)
  source 1..1931: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1328 - RNA, 1931 nt, synthetic construct
  misc_feature 1..1931: note = mRNA product Design b-2 comprising derived and/or modified sequence from HRSV(A2)__F-del_DSCav1 (opt4)
  source 1..1931: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1329 - RNA, 1931 nt, synthetic construct
  misc_feature 1..1931: note = mRNA product Design b-2 comprising derived and/or modified sequence from HRSV(A2)__F-del_DSCav1 (opt5)
  source 1..1931: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1330 - RNA, 1931 nt, synthetic construct
  misc_feature 1..1931: note = mRNA product Design b-2 comprising derived and/or modified sequence from HRSV(A2)__F-del_DSCav1 (opt6)
  source 1..1931: mol_type = other RNA
gggagagcctctgctggagtccggggagtggcgttggctgctagagcgaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1331 - RNA, 1931 nt, synthetic construct
  misc_feature 1..1931: note = mRNA product Design b-2 comprising derived and/or modified sequence from HRSV(A2)__F-del_DSCav1 (opt11)
  source 1..1931: mol_type = other RNA
gggagagcctctgctggagtccggggagtggcgttggctgctagagcgaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1332 - RNA, 1951 nt, synthetic construct
  misc_feature 1..1951: note = mRNA product Design b-3 comprising derived and/or modified sequence from HRSV(A2)__F-del_DSCav1 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1333 - RNA, 1951 nt, synthetic construct
  misc_feature 1..1951: note = mRNA product Design b-3 comprising derived and/or modified sequence from HRSV(A2)__F-del_DSCav1 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1334 - RNA, 1951 nt, synthetic construct
  misc_feature 1..1951: note = mRNA product Design b-3 comprising derived and/or modified sequence from HRSV(A2)__F-del_DSCav1 (opt2)
  source 1..1951: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1335 - RNA, 1951 nt, synthetic construct
  misc_feature 1..1951: note = mRNA product Design b-3 comprising derived and/or modified sequence from HRSV(A2)__F-del_DSCav1 (opt3)
  source 1..1951: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1336 - RNA, 1951 nt, synthetic construct
  misc_feature 1..1951: note = mRNA product Design b-3 comprising derived and/or modified sequence from HRSV(A2)__F-del_DSCav1 (opt4)
  source 1..1951: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1337 - RNA, 1951 nt, synthetic construct
  misc_feature 1..1951: note = mRNA product Design b-3 comprising derived and/or modified sequence from HRSV(A2)__F-del_DSCav1 (opt5)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1338 - RNA, 1951 nt, synthetic construct
  misc_feature 1..1951: note = mRNA product Design b-3 comprising derived and/or modified sequence from HRSV(A2)__F-del_DSCav1 (opt6)
  source 1..1951: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1339 - RNA, 1951 nt, synthetic construct
  misc_feature 1..1951: note = mRNA product Design b-3 comprising derived and/or modified sequence from HRSV(A2)__F-del_DSCav1 (opt11)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1340 - RNA, 2002 nt, synthetic construct
  misc_feature 1..2002: note = mRNA product Design b-4 comprising derived and/or modified sequence from HRSV(A2)__F-del_DSCav1 (opt1)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1341 - RNA, 2002 nt, synthetic construct
  misc_feature 1..2002: note = mRNA product Design b-4 comprising derived and/or modified sequence from HRSV(A2)__F-del_DSCav1 (opt1)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1342 - RNA, 2002 nt, synthetic construct
  misc_feature 1..2002: note = mRNA product Design b-4 comprising derived and/or modified sequence from HRSV(A2)__F-del_DSCav1 (opt2)
  source 1..2002: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1343 - RNA, 2002 nt, synthetic construct
  misc_feature 1..2002: note = mRNA product Design b-4 comprising derived and/or modified sequence from HRSV(A2)__F-del_DSCav1 (opt3)
  source 1..2002: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1344 - RNA, 2002 nt, synthetic construct
  misc_feature 1..2002: note = mRNA product Design b-4 comprising derived and/or modified sequence from HRSV(A2)__F-del_DSCav1 (opt4)
  source 1..2002: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1345 - RNA, 2002 nt, synthetic construct
  misc_feature 1..2002: note = mRNA product Design b-4 comprising derived and/or modified sequence from HRSV(A2)__F-del_DSCav1 (opt5)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1346 - RNA, 2002 nt, synthetic construct
  misc_feature 1..2002: note = mRNA product Design b-4 comprising derived and/or modified sequence from HRSV(A2)__F-del_DSCav1 (opt6)
  source 1..2002: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1347 - RNA, 2002 nt, synthetic construct
  misc_feature 1..2002: note = mRNA product Design b-4 comprising derived and/or modified sequence from HRSV(A2)__F-del_DSCav1 (opt11)
  source 1..2002: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1348 - RNA, 2064 nt, synthetic construct
  misc_feature 1..2064: note = mRNA product Design b-5 comprising derived and/or modified sequence from HRSV(A2)__F-del_DSCav1 (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1349 - RNA, 2064 nt, synthetic construct
  misc_feature 1..2064: note = mRNA product Design b-5 comprising derived and/or modified sequence from HRSV(A2)__F-del_DSCav1 (opt1)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1350 - RNA, 2064 nt, synthetic construct
  misc_feature 1..2064: note = mRNA product Design b-5 comprising derived and/or modified sequence from HRSV(A2)__F-del_DSCav1 (opt2)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1351 - RNA, 2064 nt, synthetic construct
  misc_feature 1..2064: note = mRNA product Design b-5 comprising derived and/or modified sequence from HRSV(A2)__F-del_DSCav1 (opt3)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1352 - RNA, 2064 nt, synthetic construct
  misc_feature 1..2064: note = mRNA product Design b-5 comprising derived and/or modified sequence from HRSV(A2)__F-del_DSCav1 (opt4)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1353 - RNA, 2064 nt, synthetic construct
  misc_feature 1..2064: note = mRNA product Design b-5 comprising derived and/or modified sequence from HRSV(A2)__F-del_DSCav1 (opt5)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1354 - RNA, 2064 nt, synthetic construct
  misc_feature 1..2064: note = mRNA product Design b-5 comprising derived and/or modified sequence from HRSV(A2)__F-del_DSCav1 (opt6)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1355 - RNA, 2064 nt, synthetic construct
  misc_feature 1..2064: note = mRNA product Design b-5 comprising derived and/or modified sequence from HRSV(A2)__F-del_DSCav1 (opt11)
  source 1..2064: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1356 - RNA, 1970 nt, synthetic construct
  misc_feature 1..1970: note = mRNA product Design c-1 comprising derived and/or modified sequence from HRSV(A2)__F-del_DSCav1 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1357 - RNA, 1970 nt, synthetic construct
  misc_feature 1..1970: note = mRNA product Design c-1 comprising derived and/or modified sequence from HRSV(A2)__F-del_DSCav1 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1358 - RNA, 1970 nt, synthetic construct
  misc_feature 1..1970: note = mRNA product Design c-1 comprising derived and/or modified sequence from HRSV(A2)__F-del_DSCav1 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1359 - RNA, 1970 nt, synthetic construct
  misc_feature 1..1970: note = mRNA product Design c-1 comprising derived and/or modified sequence from HRSV(A2)__F-del_DSCav1 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1360 - RNA, 1970 nt, synthetic construct
  misc_feature 1..1970: note = mRNA product Design c-1 comprising derived and/or modified sequence from HRSV(A2)__F-del_DSCav1 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1361 - RNA, 1970 nt, synthetic construct
  misc_feature 1..1970: note = mRNA product Design c-1 comprising derived and/or modified sequence from HRSV(A2)__F-del_DSCav1 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1362 - RNA, 1970 nt, synthetic construct
  misc_feature 1..1970: note = mRNA product Design c-1 comprising derived and/or modified sequence from HRSV(A2)__F-del_DSCav1 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1363 - RNA, 1970 nt, synthetic construct
  misc_feature 1..1970: note = mRNA product Design c-1 comprising derived and/or modified sequence from HRSV(A2)__F-del_DSCav1 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1364 - RNA, 2060 nt, synthetic construct
  misc_feature 1..2060: note = mRNA product Design c-2 comprising derived and/or modified sequence from HRSV(A2)__F-del_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1365 - RNA, 2060 nt, synthetic construct
  misc_feature 1..2060: note = mRNA product Design c-2 comprising derived and/or modified sequence from HRSV(A2)__F-del_DSCav1 (opt1)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1366 - RNA, 2060 nt, synthetic construct
  misc_feature 1..2060: note = mRNA product Design c-2 comprising derived and/or modified sequence from HRSV(A2)__F-del_DSCav1 (opt2)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1367 - RNA, 2060 nt, synthetic construct
  misc_feature 1..2060: note = mRNA product Design c-2 comprising derived and/or modified sequence from HRSV(A2)__F-del_DSCav1 (opt3)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1368 - RNA, 2060 nt, synthetic construct
  misc_feature 1..2060: note = mRNA product Design c-2 comprising derived and/or modified sequence from HRSV(A2)__F-del_DSCav1 (opt4)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1369 - RNA, 2060 nt, synthetic construct
  misc_feature 1..2060: note = mRNA product Design c-2 comprising derived and/or modified sequence from HRSV(A2)__F-del_DSCav1 (opt5)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1370 - RNA, 2060 nt, synthetic construct
  misc_feature 1..2060: note = mRNA product Design c-2 comprising derived and/or modified sequence from HRSV(A2)__F-del_DSCav1 (opt6)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1371 - RNA, 2060 nt, synthetic construct
  misc_feature 1..2060: note = mRNA product Design c-2 comprising derived and/or modified sequence from HRSV(A2)__F-del_DSCav1 (opt11)
  source 1..2060: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1372 - RNA, 2037 nt, synthetic construct
  misc_feature 1..2037: note = mRNA product Design c-3 comprising derived and/or modified sequence from HRSV(A2)__F-del_DSCav1 (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1373 - RNA, 2037 nt, synthetic construct
  misc_feature 1..2037: note = mRNA product Design c-3 comprising derived and/or modified sequence from HRSV(A2)__F-del_DSCav1 (opt1)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1374 - RNA, 2037 nt, synthetic construct
  misc_feature 1..2037: note = mRNA product Design c-3 comprising derived and/or modified sequence from HRSV(A2)__F-del_DSCav1 (opt2)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1375 - RNA, 2037 nt, synthetic construct
  misc_feature 1..2037: note = mRNA product Design c-3 comprising derived and/or modified sequence from HRSV(A2)__F-del_DSCav1 (opt3)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1376 - RNA, 2037 nt, synthetic construct
  misc_feature 1..2037: note = mRNA product Design c-3 comprising derived and/or modified sequence from HRSV(A2)__F-del_DSCav1 (opt4)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1377 - RNA, 2037 nt, synthetic construct
  misc_feature 1..2037: note = mRNA product Design c-3 comprising derived and/or modified sequence from HRSV(A2)__F-del_DSCav1 (opt5)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1378 - RNA, 2037 nt, synthetic construct
  misc_feature 1..2037: note = mRNA product Design c-3 comprising derived and/or modified sequence from HRSV(A2)__F-del_DSCav1 (opt6)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1379 - RNA, 2037 nt, synthetic construct
  misc_feature 1..2037: note = mRNA product Design c-3 comprising derived and/or modified sequence from HRSV(A2)__F-del_DSCav1 (opt11)
  source 1..2037: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1380 - RNA, 2033 nt, synthetic construct
  misc_feature 1..2033: note = mRNA product Design c-4 comprising derived and/or modified sequence from HRSV(A2)__F-del_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1381 - RNA, 2033 nt, synthetic construct
  misc_feature 1..2033: note = mRNA product Design c-4 comprising derived and/or modified sequence from HRSV(A2)__F-del_DSCav1 (opt1)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1382 - RNA, 2033 nt, synthetic construct
  misc_feature 1..2033: note = mRNA product Design c-4 comprising derived and/or modified sequence from HRSV(A2)__F-del_DSCav1 (opt2)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1383 - RNA, 2033 nt, synthetic construct
  misc_feature 1..2033: note = mRNA product Design c-4 comprising derived and/or modified sequence from HRSV(A2)__F-del_DSCav1 (opt3)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1384 - RNA, 2033 nt, synthetic construct
  misc_feature 1..2033: note = mRNA product Design c-4 comprising derived and/or modified sequence from HRSV(A2)__F-del_DSCav1 (opt4)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1385 - RNA, 2033 nt, synthetic construct
  misc_feature 1..2033: note = mRNA product Design c-4 comprising derived and/or modified sequence from HRSV(A2)__F-del_DSCav1 (opt5)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1386 - RNA, 2033 nt, synthetic construct
  misc_feature 1..2033: note = mRNA product Design c-4 comprising derived and/or modified sequence from HRSV(A2)__F-del_DSCav1 (opt6)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1387 - RNA, 2033 nt, synthetic construct
  misc_feature 1..2033: note = mRNA product Design c-4 comprising derived and/or modified sequence from HRSV(A2)__F-del_DSCav1 (opt11)
  source 1..2033: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1388 - RNA, 1951 nt, synthetic construct
  misc_feature 1..1951: note = mRNA product Design c-5 comprising derived and/or modified sequence from HRSV(A2)__F-del_DSCav1 (opt1)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1389 - RNA, 1951 nt, synthetic construct
  misc_feature 1..1951: note = mRNA product Design c-5 comprising derived and/or modified sequence from HRSV(A2)__F-del_DSCav1 (opt1)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1390 - RNA, 1951 nt, synthetic construct
  misc_feature 1..1951: note = mRNA product Design c-5 comprising derived and/or modified sequence from HRSV(A2)__F-del_DSCav1 (opt2)
  source 1..1951: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1391 - RNA, 1951 nt, synthetic construct
  misc_feature 1..1951: note = mRNA product Design c-5 comprising derived and/or modified sequence from HRSV(A2)__F-del_DSCav1 (opt3)
  source 1..1951: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1392 - RNA, 1951 nt, synthetic construct
  misc_feature 1..1951: note = mRNA product Design c-5 comprising derived and/or modified sequence from HRSV(A2)__F-del_DSCav1 (opt4)
  source 1..1951: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1393 - RNA, 1951 nt, synthetic construct
  misc_feature 1..1951: note = mRNA product Design c-5 comprising derived and/or modified sequence from HRSV(A2)__F-del_DSCav1 (opt5)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1394 - RNA, 1951 nt, synthetic construct
  misc_feature 1..1951: note = mRNA product Design c-5 comprising derived and/or modified sequence from HRSV(A2)__F-del_DSCav1 (opt6)
  source 1..1951: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1395 - RNA, 1951 nt, synthetic construct
  misc_feature 1..1951: note = mRNA product Design c-5 comprising derived and/or modified sequence from HRSV(A2)__F-del_DSCav1 (opt11)
  source 1..1951: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1396 - RNA, 1960 nt, synthetic construct
  misc_feature 1..1960: note = mRNA product Design d-1 comprising derived and/or modified sequence from HRSV(A2)__F-del_DSCav1 (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1397 - RNA, 1960 nt, synthetic construct
  misc_feature 1..1960: note = mRNA product Design d-1 comprising derived and/or modified sequence from HRSV(A2)__F-del_DSCav1 (opt1)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1398 - RNA, 1960 nt, synthetic construct
  misc_feature 1..1960: note = mRNA product Design d-1 comprising derived and/or modified sequence from HRSV(A2)__F-del_DSCav1 (opt2)
  source 1..1960: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1399 - RNA, 1960 nt, synthetic construct
  misc_feature 1..1960: note = mRNA product Design d-1 comprising derived and/or modified sequence from HRSV(A2)__F-del_DSCav1 (opt3)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1400 - RNA, 1960 nt, synthetic construct
  misc_feature 1..1960: note = mRNA product Design d-1 comprising derived and/or modified sequence from HRSV(A2)__F-del_DSCav1 (opt4)
  source 1..1960: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1401 - RNA, 1960 nt, synthetic construct
  misc_feature 1..1960: note = mRNA product Design d-1 comprising derived and/or modified sequence from HRSV(A2)__F-del_DSCav1 (opt5)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1402 - RNA, 1960 nt, synthetic construct
  misc_feature 1..1960: note = mRNA product Design d-1 comprising derived and/or modified sequence from HRSV(A2)__F-del_DSCav1 (opt6)
  source 1..1960: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1403 - RNA, 1960 nt, synthetic construct
  misc_feature 1..1960: note = mRNA product Design d-1 comprising derived and/or modified sequence from HRSV(A2)__F-del_DSCav1 (opt11)
  source 1..1960: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1404 - RNA, 2015 nt, synthetic construct
  misc_feature 1..2015: note = mRNA product Design d-2 comprising derived and/or modified sequence from HRSV(A2)__F-del_DSCav1 (opt1)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1405 - RNA, 2015 nt, synthetic construct
  misc_feature 1..2015: note = mRNA product Design d-2 comprising derived and/or modified sequence from HRSV(A2)__F-del_DSCav1 (opt1)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1406 - RNA, 2015 nt, synthetic construct
  misc_feature 1..2015: note = mRNA product Design d-2 comprising derived and/or modified sequence from HRSV(A2)__F-del_DSCav1 (opt2)
  source 1..2015: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1407 - RNA, 2015 nt, synthetic construct
  misc_feature 1..2015: note = mRNA product Design d-2 comprising derived and/or modified sequence from HRSV(A2)__F-del_DSCav1 (opt3)
  source 1..2015: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1408 - RNA, 2015 nt, synthetic construct
  misc_feature 1..2015: note = mRNA product Design d-2 comprising derived and/or modified sequence from HRSV(A2)__F-del_DSCav1 (opt4)
  source 1..2015: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1409 - RNA, 2015 nt, synthetic construct
  misc_feature 1..2015: note = mRNA product Design d-2 comprising derived and/or modified sequence from HRSV(A2)__F-del_DSCav1 (opt5)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1410 - RNA, 2015 nt, synthetic construct
  misc_feature 1..2015: note = mRNA product Design d-2 comprising derived and/or modified sequence from HRSV(A2)__F-del_DSCav1 (opt6)
  source 1..2015: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1411 - RNA, 2015 nt, synthetic construct
  misc_feature 1..2015: note = mRNA product Design d-2 comprising derived and/or modified sequence from HRSV(A2)__F-del_DSCav1 (opt11)
  source 1..2015: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1412 - RNA, 2331 nt, synthetic construct
  misc_feature 1..2331: note = mRNA product Design d-3 comprising derived and/or modified sequence from HRSV(A2)__F-del_DSCav1 (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1413 - RNA, 2331 nt, synthetic construct
  misc_feature 1..2331: note = mRNA product Design d-3 comprising derived and/or modified sequence from HRSV(A2)__F-del_DSCav1 (opt1)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1414 - RNA, 2331 nt, synthetic construct
  misc_feature 1..2331: note = mRNA product Design d-3 comprising derived and/or modified sequence from HRSV(A2)__F-del_DSCav1 (opt2)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1415 - RNA, 2331 nt, synthetic construct
  misc_feature 1..2331: note = mRNA product Design d-3 comprising derived and/or modified sequence from HRSV(A2)__F-del_DSCav1 (opt3)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1416 - RNA, 2331 nt, synthetic construct
  misc_feature 1..2331: note = mRNA product Design d-3 comprising derived and/or modified sequence from HRSV(A2)__F-del_DSCav1 (opt4)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1417 - RNA, 2331 nt, synthetic construct
  misc_feature 1..2331: note = mRNA product Design d-3 comprising derived and/or modified sequence from HRSV(A2)__F-del_DSCav1 (opt5)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1418 - RNA, 2331 nt, synthetic construct
  misc_feature 1..2331: note = mRNA product Design d-3 comprising derived and/or modified sequence from HRSV(A2)__F-del_DSCav1 (opt6)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1419 - RNA, 2331 nt, synthetic construct
  misc_feature 1..2331: note = mRNA product Design d-3 comprising derived and/or modified sequence from HRSV(A2)__F-del_DSCav1 (opt11)
  source 1..2331: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1420 - RNA, 2014 nt, synthetic construct
  misc_feature 1..2014: note = mRNA product Design d-4 comprising derived and/or modified sequence from HRSV(A2)__F-del_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1421 - RNA, 2014 nt, synthetic construct
  misc_feature 1..2014: note = mRNA product Design d-4 comprising derived and/or modified sequence from HRSV(A2)__F-del_DSCav1 (opt1)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1422 - RNA, 2014 nt, synthetic construct
  misc_feature 1..2014: note = mRNA product Design d-4 comprising derived and/or modified sequence from HRSV(A2)__F-del_DSCav1 (opt2)
  source 1..2014: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1423 - RNA, 2014 nt, synthetic construct
  misc_feature 1..2014: note = mRNA product Design d-4 comprising derived and/or modified sequence from HRSV(A2)__F-del_DSCav1 (opt3)
  source 1..2014: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1424 - RNA, 2014 nt, synthetic construct
  misc_feature 1..2014: note = mRNA product Design d-4 comprising derived and/or modified sequence from HRSV(A2)__F-del_DSCav1 (opt4)
  source 1..2014: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1425 - RNA, 2014 nt, synthetic construct
  misc_feature 1..2014: note = mRNA product Design d-4 comprising derived and/or modified sequence from HRSV(A2)__F-del_DSCav1 (opt5)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1426 - RNA, 2014 nt, synthetic construct
  misc_feature 1..2014: note = mRNA product Design d-4 comprising derived and/or modified sequence from HRSV(A2)__F-del_DSCav1 (opt6)
  source 1..2014: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1427 - RNA, 2014 nt, synthetic construct
  misc_feature 1..2014: note = mRNA product Design d-4 comprising derived and/or modified sequence from HRSV(A2)__F-del_DSCav1 (opt11)
  source 1..2014: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1428 - RNA, 2111 nt, synthetic construct
  misc_feature 1..2111: note = mRNA product Design d-5 comprising derived and/or modified sequence from HRSV(A2)__F-del_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1429 - RNA, 2111 nt, synthetic construct
  misc_feature 1..2111: note = mRNA product Design d-5 comprising derived and/or modified sequence from HRSV(A2)__F-del_DSCav1 (opt1)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1430 - RNA, 2111 nt, synthetic construct
  misc_feature 1..2111: note = mRNA product Design d-5 comprising derived and/or modified sequence from HRSV(A2)__F-del_DSCav1 (opt2)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1431 - RNA, 2111 nt, synthetic construct
  misc_feature 1..2111: note = mRNA product Design d-5 comprising derived and/or modified sequence from HRSV(A2)__F-del_DSCav1 (opt3)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1432 - RNA, 2111 nt, synthetic construct
  misc_feature 1..2111: note = mRNA product Design d-5 comprising derived and/or modified sequence from HRSV(A2)__F-del_DSCav1 (opt4)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1433 - RNA, 2111 nt, synthetic construct
  misc_feature 1..2111: note = mRNA product Design d-5 comprising derived and/or modified sequence from HRSV(A2)__F-del_DSCav1 (opt5)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1434 - RNA, 2111 nt, synthetic construct
  misc_feature 1..2111: note = mRNA product Design d-5 comprising derived and/or modified sequence from HRSV(A2)__F-del_DSCav1 (opt6)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1435 - RNA, 2111 nt, synthetic construct
  misc_feature 1..2111: note = mRNA product Design d-5 comprising derived and/or modified sequence from HRSV(A2)__F-del_DSCav1 (opt11)
  source 1..2111: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1436 - RNA, 1991 nt, synthetic construct
  misc_feature 1..1991: note = mRNA product Design e-1 comprising derived and/or modified sequence from HRSV(A2)__F-del_DSCav1 (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1437 - RNA, 1991 nt, synthetic construct
  misc_feature 1..1991: note = mRNA product Design e-1 comprising derived and/or modified sequence from HRSV(A2)__F-del_DSCav1 (opt1)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1438 - RNA, 1991 nt, synthetic construct
  misc_feature 1..1991: note = mRNA product Design e-1 comprising derived and/or modified sequence from HRSV(A2)__F-del_DSCav1 (opt2)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1439 - RNA, 1991 nt, synthetic construct
  misc_feature 1..1991: note = mRNA product Design e-1 comprising derived and/or modified sequence from HRSV(A2)__F-del_DSCav1 (opt3)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1440 - RNA, 1991 nt, synthetic construct
  misc_feature 1..1991: note = mRNA product Design e-1 comprising derived and/or modified sequence from HRSV(A2)__F-del_DSCav1 (opt4)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1441 - RNA, 1991 nt, synthetic construct
  misc_feature 1..1991: note = mRNA product Design e-1 comprising derived and/or modified sequence from HRSV(A2)__F-del_DSCav1 (opt5)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1442 - RNA, 1991 nt, synthetic construct
  misc_feature 1..1991: note = mRNA product Design e-1 comprising derived and/or modified sequence from HRSV(A2)__F-del_DSCav1 (opt6)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1443 - RNA, 1991 nt, synthetic construct
  misc_feature 1..1991: note = mRNA product Design e-1 comprising derived and/or modified sequence from HRSV(A2)__F-del_DSCav1 (opt11)
  source 1..1991: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1444 - RNA, 1973 nt, synthetic construct
  misc_feature 1..1973: note = mRNA product Design e-2 comprising derived and/or modified sequence from HRSV(A2)__F-del_DSCav1 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1445 - RNA, 1973 nt, synthetic construct
  misc_feature 1..1973: note = mRNA product Design e-2 comprising derived and/or modified sequence from HRSV(A2)__F-del_DSCav1 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1446 - RNA, 1973 nt, synthetic construct
  misc_feature 1..1973: note = mRNA product Design e-2 comprising derived and/or modified sequence from HRSV(A2)__F-del_DSCav1 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1447 - RNA, 1973 nt, synthetic construct
  misc_feature 1..1973: note = mRNA product Design e-2 comprising derived and/or modified sequence from HRSV(A2)__F-del_DSCav1 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1448 - RNA, 1973 nt, synthetic construct
  misc_feature 1..1973: note = mRNA product Design e-2 comprising derived and/or modified sequence from HRSV(A2)__F-del_DSCav1 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1449 - RNA, 1973 nt, synthetic construct
  misc_feature 1..1973: note = mRNA product Design e-2 comprising derived and/or modified sequence from HRSV(A2)__F-del_DSCav1 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1450 - RNA, 1973 nt, synthetic construct
  misc_feature 1..1973: note = mRNA product Design e-2 comprising derived and/or modified sequence from HRSV(A2)__F-del_DSCav1 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1451 - RNA, 1973 nt, synthetic construct
  misc_feature 1..1973: note = mRNA product Design e-2 comprising derived and/or modified sequence from HRSV(A2)__F-del_DSCav1 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1452 - RNA, 1943 nt, synthetic construct
  misc_feature 1..1943: note = mRNA product Design e-3 comprising derived and/or modified sequence from HRSV(A2)__F-del_DSCav1 (opt1)
  source 1..1943: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1453 - RNA, 1943 nt, synthetic construct
  misc_feature 1..1943: note = mRNA product Design e-3 comprising derived and/or modified sequence from HRSV(A2)__F-del_DSCav1 (opt1)
  source 1..1943: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1454 - RNA, 1943 nt, synthetic construct
  misc_feature 1..1943: note = mRNA product Design e-3 comprising derived and/or modified sequence from HRSV(A2)__F-del_DSCav1 (opt2)
  source 1..1943: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1455 - RNA, 1943 nt, synthetic construct
  misc_feature 1..1943: note = mRNA product Design e-3 comprising derived and/or modified sequence from HRSV(A2)__F-del_DSCav1 (opt3)
  source 1..1943: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1456 - RNA, 1943 nt, synthetic construct
  misc_feature 1..1943: note = mRNA product Design e-3 comprising derived and/or modified sequence from HRSV(A2)__F-del_DSCav1 (opt4)
  source 1..1943: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1457 - RNA, 1943 nt, synthetic construct
  misc_feature 1..1943: note = mRNA product Design e-3 comprising derived and/or modified sequence from HRSV(A2)__F-del_DSCav1 (opt5)
  source 1..1943: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1458 - RNA, 1943 nt, synthetic construct
  misc_feature 1..1943: note = mRNA product Design e-3 comprising derived and/or modified sequence from HRSV(A2)__F-del_DSCav1 (opt6)
  source 1..1943: mol_type = other RNA
gggagactttcccattctgtagcagaatttggtgttgcctgtggtcttggtcccgcggagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1459 - RNA, 1943 nt, synthetic construct
  misc_feature 1..1943: note = mRNA product Design e-3 comprising derived and/or modified sequence from HRSV(A2)__F-del_DSCav1 (opt11)
  source 1..1943: mol_type = other RNA
gggagactttcccattctgtagcagaatttggtgttgcctgtggtcttggtcccgcggagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1460 - RNA, 1997 nt, synthetic construct
  misc_feature 1..1997: note = mRNA product Design e-4 comprising derived and/or modified sequence from HRSV(A2)__F-del_DSCav1 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1461 - RNA, 1997 nt, synthetic construct
  misc_feature 1..1997: note = mRNA product Design e-4 comprising derived and/or modified sequence from HRSV(A2)__F-del_DSCav1 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1462 - RNA, 1997 nt, synthetic construct
  misc_feature 1..1997: note = mRNA product Design e-4 comprising derived and/or modified sequence from HRSV(A2)__F-del_DSCav1 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1463 - RNA, 1997 nt, synthetic construct
  misc_feature 1..1997: note = mRNA product Design e-4 comprising derived and/or modified sequence from HRSV(A2)__F-del_DSCav1 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1464 - RNA, 1997 nt, synthetic construct
  misc_feature 1..1997: note = mRNA product Design e-4 comprising derived and/or modified sequence from HRSV(A2)__F-del_DSCav1 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1465 - RNA, 1997 nt, synthetic construct
  misc_feature 1..1997: note = mRNA product Design e-4 comprising derived and/or modified sequence from HRSV(A2)__F-del_DSCav1 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1466 - RNA, 1997 nt, synthetic construct
  misc_feature 1..1997: note = mRNA product Design e-4 comprising derived and/or modified sequence from HRSV(A2)__F-del_DSCav1 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1467 - RNA, 1997 nt, synthetic construct
  misc_feature 1..1997: note = mRNA product Design e-4 comprising derived and/or modified sequence from HRSV(A2)__F-del_DSCav1 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1468 - RNA, 1964 nt, synthetic construct
  misc_feature 1..1964: note = mRNA product Design e-5 comprising derived and/or modified sequence from HRSV(A2)__F-del_DSCav1 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1469 - RNA, 1964 nt, synthetic construct
  misc_feature 1..1964: note = mRNA product Design e-5 comprising derived and/or modified sequence from HRSV(A2)__F-del_DSCav1 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1470 - RNA, 1964 nt, synthetic construct
  misc_feature 1..1964: note = mRNA product Design e-5 comprising derived and/or modified sequence from HRSV(A2)__F-del_DSCav1 (opt2)
  source 1..1964: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1471 - RNA, 1964 nt, synthetic construct
  misc_feature 1..1964: note = mRNA product Design e-5 comprising derived and/or modified sequence from HRSV(A2)__F-del_DSCav1 (opt3)
  source 1..1964: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1472 - RNA, 1964 nt, synthetic construct
  misc_feature 1..1964: note = mRNA product Design e-5 comprising derived and/or modified sequence from HRSV(A2)__F-del_DSCav1 (opt4)
  source 1..1964: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1473 - RNA, 1964 nt, synthetic construct
  misc_feature 1..1964: note = mRNA product Design e-5 comprising derived and/or modified sequence from HRSV(A2)__F-del_DSCav1 (opt5)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1474 - RNA, 1964 nt, synthetic construct
  misc_feature 1..1964: note = mRNA product Design e-5 comprising derived and/or modified sequence from HRSV(A2)__F-del_DSCav1 (opt6)
  source 1..1964: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1475 - RNA, 1964 nt, synthetic construct
  misc_feature 1..1964: note = mRNA product Design e-5 comprising derived and/or modified sequence from HRSV(A2)__F-del_DSCav1 (opt11)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1476 - RNA, 2031 nt, synthetic construct
  misc_feature 1..2031: note = mRNA product Design e-6 comprising derived and/or modified sequence from HRSV(A2)__F-del_DSCav1 (opt1)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1477 - RNA, 2031 nt, synthetic construct
  misc_feature 1..2031: note = mRNA product Design e-6 comprising derived and/or modified sequence from HRSV(A2)__F-del_DSCav1 (opt1)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1478 - RNA, 2031 nt, synthetic construct
  misc_feature 1..2031: note = mRNA product Design e-6 comprising derived and/or modified sequence from HRSV(A2)__F-del_DSCav1 (opt2)
  source 1..2031: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1479 - RNA, 2031 nt, synthetic construct
  misc_feature 1..2031: note = mRNA product Design e-6 comprising derived and/or modified sequence from HRSV(A2)__F-del_DSCav1 (opt3)
  source 1..2031: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1480 - RNA, 2031 nt, synthetic construct
  misc_feature 1..2031: note = mRNA product Design e-6 comprising derived and/or modified sequence from HRSV(A2)__F-del_DSCav1 (opt4)
  source 1..2031: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1481 - RNA, 2031 nt, synthetic construct
  misc_feature 1..2031: note = mRNA product Design e-6 comprising derived and/or modified sequence from HRSV(A2)__F-del_DSCav1 (opt5)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1482 - RNA, 2031 nt, synthetic construct
  misc_feature 1..2031: note = mRNA product Design e-6 comprising derived and/or modified sequence from HRSV(A2)__F-del_DSCav1 (opt6)
  source 1..2031: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1483 - RNA, 2031 nt, synthetic construct
  misc_feature 1..2031: note = mRNA product Design e-6 comprising derived and/or modified sequence from HRSV(A2)__F-del_DSCav1 (opt11)
  source 1..2031: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1484 - RNA, 2247 nt, synthetic construct
  misc_feature 1..2247: note = mRNA product Design f-1 comprising derived and/or modified sequence from HRSV(A2)__F-del_DSCav1 (opt1)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1485 - RNA, 2247 nt, synthetic construct
  misc_feature 1..2247: note = mRNA product Design f-1 comprising derived and/or modified sequence from HRSV(A2)__F-del_DSCav1 (opt1)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1486 - RNA, 2247 nt, synthetic construct
  misc_feature 1..2247: note = mRNA product Design f-1 comprising derived and/or modified sequence from HRSV(A2)__F-del_DSCav1 (opt2)
  source 1..2247: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1487 - RNA, 2247 nt, synthetic construct
  misc_feature 1..2247: note = mRNA product Design f-1 comprising derived and/or modified sequence from HRSV(A2)__F-del_DSCav1 (opt3)
  source 1..2247: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1488 - RNA, 2247 nt, synthetic construct
  misc_feature 1..2247: note = mRNA product Design f-1 comprising derived and/or modified sequence from HRSV(A2)__F-del_DSCav1 (opt4)
  source 1..2247: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1489 - RNA, 2247 nt, synthetic construct
  misc_feature 1..2247: note = mRNA product Design f-1 comprising derived and/or modified sequence from HRSV(A2)__F-del_DSCav1 (opt5)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1490 - RNA, 2247 nt, synthetic construct
  misc_feature 1..2247: note = mRNA product Design f-1 comprising derived and/or modified sequence from HRSV(A2)__F-del_DSCav1 (opt6)
  source 1..2247: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1491 - RNA, 2247 nt, synthetic construct
  misc_feature 1..2247: note = mRNA product Design f-1 comprising derived and/or modified sequence from HRSV(A2)__F-del_DSCav1 (opt11)
  source 1..2247: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1492 - RNA, 2027 nt, synthetic construct
  misc_feature 1..2027: note = mRNA product Design f-2 comprising derived and/or modified sequence from HRSV(A2)__F-del_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1493 - RNA, 2027 nt, synthetic construct
  misc_feature 1..2027: note = mRNA product Design f-2 comprising derived and/or modified sequence from HRSV(A2)__F-del_DSCav1 (opt1)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1494 - RNA, 2027 nt, synthetic construct
  misc_feature 1..2027: note = mRNA product Design f-2 comprising derived and/or modified sequence from HRSV(A2)__F-del_DSCav1 (opt2)
  source 1..2027: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1495 - RNA, 2027 nt, synthetic construct
  misc_feature 1..2027: note = mRNA product Design f-2 comprising derived and/or modified sequence from HRSV(A2)__F-del_DSCav1 (opt3)
  source 1..2027: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1496 - RNA, 2027 nt, synthetic construct
  misc_feature 1..2027: note = mRNA product Design f-2 comprising derived and/or modified sequence from HRSV(A2)__F-del_DSCav1 (opt4)
  source 1..2027: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1497 - RNA, 2027 nt, synthetic construct
  misc_feature 1..2027: note = mRNA product Design f-2 comprising derived and/or modified sequence from HRSV(A2)__F-del_DSCav1 (opt5)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1498 - RNA, 2027 nt, synthetic construct
  misc_feature 1..2027: note = mRNA product Design f-2 comprising derived and/or modified sequence from HRSV(A2)__F-del_DSCav1 (opt6)
  source 1..2027: mol_type = other RNA
gggagagcggctcggccattttgtcccagtcagtccggaggctgcggctgcagaagtaccgcctgcggagtaactgcaaagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1499 - RNA, 2027 nt, synthetic construct
  misc_feature 1..2027: note = mRNA product Design f-2 comprising derived and/or modified sequence from HRSV(A2)__F-del_DSCav1 (opt11)
  source 1..2027: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1500 - RNA, 2018 nt, synthetic construct
  misc_feature 1..2018: note = mRNA product Design f-3 comprising derived and/or modified sequence from HRSV(A2)__F-del_DSCav1 (opt1)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1501 - RNA, 2018 nt, synthetic construct
  misc_feature 1..2018: note = mRNA product Design f-3 comprising derived and/or modified sequence from HRSV(A2)__F-del_DSCav1 (opt1)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1502 - RNA, 2018 nt, synthetic construct
  misc_feature 1..2018: note = mRNA product Design f-3 comprising derived and/or modified sequence from HRSV(A2)__F-del_DSCav1 (opt2)
  source 1..2018: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1503 - RNA, 2018 nt, synthetic construct
  misc_feature 1..2018: note = mRNA product Design f-3 comprising derived and/or modified sequence from HRSV(A2)__F-del_DSCav1 (opt3)
  source 1..2018: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1504 - RNA, 2018 nt, synthetic construct
  misc_feature 1..2018: note = mRNA product Design f-3 comprising derived and/or modified sequence from HRSV(A2)__F-del_DSCav1 (opt4)
  source 1..2018: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1505 - RNA, 2018 nt, synthetic construct
  misc_feature 1..2018: note = mRNA product Design f-3 comprising derived and/or modified sequence from HRSV(A2)__F-del_DSCav1 (opt5)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1506 - RNA, 2018 nt, synthetic construct
  misc_feature 1..2018: note = mRNA product Design f-3 comprising derived and/or modified sequence from HRSV(A2)__F-del_DSCav1 (opt6)
  source 1..2018: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1507 - RNA, 2018 nt, synthetic construct
  misc_feature 1..2018: note = mRNA product Design f-3 comprising derived and/or modified sequence from HRSV(A2)__F-del_DSCav1 (opt11)
  source 1..2018: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1508 - RNA, 2234 nt, synthetic construct
  misc_feature 1..2234: note = mRNA product Design f-4 comprising derived and/or modified sequence from HRSV(A2)__F-del_DSCav1 (opt1)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1509 - RNA, 2234 nt, synthetic construct
  misc_feature 1..2234: note = mRNA product Design f-4 comprising derived and/or modified sequence from HRSV(A2)__F-del_DSCav1 (opt1)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1510 - RNA, 2234 nt, synthetic construct
  misc_feature 1..2234: note = mRNA product Design f-4 comprising derived and/or modified sequence from HRSV(A2)__F-del_DSCav1 (opt2)
  source 1..2234: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1511 - RNA, 2234 nt, synthetic construct
  misc_feature 1..2234: note = mRNA product Design f-4 comprising derived and/or modified sequence from HRSV(A2)__F-del_DSCav1 (opt3)
  source 1..2234: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1512 - RNA, 2234 nt, synthetic construct
  misc_feature 1..2234: note = mRNA product Design f-4 comprising derived and/or modified sequence from HRSV(A2)__F-del_DSCav1 (opt4)
  source 1..2234: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1513 - RNA, 2234 nt, synthetic construct
  misc_feature 1..2234: note = mRNA product Design f-4 comprising derived and/or modified sequence from HRSV(A2)__F-del_DSCav1 (opt5)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1514 - RNA, 2234 nt, synthetic construct
  misc_feature 1..2234: note = mRNA product Design f-4 comprising derived and/or modified sequence from HRSV(A2)__F-del_DSCav1 (opt6)
  source 1..2234: mol_type = other RNA
gggagagtcccgcagtcggcgtccagcggctctgcttgttcgtgtgtgtgtcgttgcaggccttattcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1515 - RNA, 2234 nt, synthetic construct
  misc_feature 1..2234: note = mRNA product Design f-4 comprising derived and/or modified sequence from HRSV(A2)__F-del_DSCav1 (opt11)
  source 1..2234: mol_type = other RNA
gggagagtcccgcagtcggcgtccagcggctctgcttgttcgtgtgtgtgtcgttgcaggccttattcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1516 - RNA, 2010 nt, synthetic construct
  misc_feature 1..2010: note = mRNA product Design f-5 comprising derived and/or modified sequence from HRSV(A2)__F-del_DSCav1 (opt1)
  source 1..2010: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1517 - RNA, 2010 nt, synthetic construct
  misc_feature 1..2010: note = mRNA product Design f-5 comprising derived and/or modified sequence from HRSV(A2)__F-del_DSCav1 (opt1)
  source 1..2010: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1518 - RNA, 2010 nt, synthetic construct
  misc_feature 1..2010: note = mRNA product Design f-5 comprising derived and/or modified sequence from HRSV(A2)__F-del_DSCav1 (opt2)
  source 1..2010: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1519 - RNA, 2010 nt, synthetic construct
  misc_feature 1..2010: note = mRNA product Design f-5 comprising derived and/or modified sequence from HRSV(A2)__F-del_DSCav1 (opt3)
  source 1..2010: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1520 - RNA, 2010 nt, synthetic construct
  misc_feature 1..2010: note = mRNA product Design f-5 comprising derived and/or modified sequence from HRSV(A2)__F-del_DSCav1 (opt4)
  source 1..2010: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1521 - RNA, 2010 nt, synthetic construct
  misc_feature 1..2010: note = mRNA product Design f-5 comprising derived and/or modified sequence from HRSV(A2)__F-del_DSCav1 (opt5)
  source 1..2010: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1522 - RNA, 2010 nt, synthetic construct
  misc_feature 1..2010: note = mRNA product Design f-5 comprising derived and/or modified sequence from HRSV(A2)__F-del_DSCav1 (opt6)
  source 1..2010: mol_type = other RNA
gggagactttcccattctgtagcagaatttggtgttgcctgtggtcttggtcccgcggagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1523 - RNA, 2010 nt, synthetic construct
  misc_feature 1..2010: note = mRNA product Design f-5 comprising derived and/or modified sequence from HRSV(A2)__F-del_DSCav1 (opt11)
  source 1..2010: mol_type = other RNA
gggagactttcccattctgtagcagaatttggtgttgcctgtggtcttggtcccgcggagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1524 - RNA, 2006 nt, synthetic construct
  misc_feature 1..2006: note = mRNA product Design g-1 comprising derived and/or modified sequence from HRSV(A2)__F-del_DSCav1 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1525 - RNA, 2006 nt, synthetic construct
  misc_feature 1..2006: note = mRNA product Design g-1 comprising derived and/or modified sequence from HRSV(A2)__F-del_DSCav1 (opt1)
  source 1..2006: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1526 - RNA, 2006 nt, synthetic construct
  misc_feature 1..2006: note = mRNA product Design g-1 comprising derived and/or modified sequence from HRSV(A2)__F-del_DSCav1 (opt2)
  source 1..2006: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1527 - RNA, 2006 nt, synthetic construct
  misc_feature 1..2006: note = mRNA product Design g-1 comprising derived and/or modified sequence from HRSV(A2)__F-del_DSCav1 (opt3)
  source 1..2006: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1528 - RNA, 2006 nt, synthetic construct
  misc_feature 1..2006: note = mRNA product Design g-1 comprising derived and/or modified sequence from HRSV(A2)__F-del_DSCav1 (opt4)
  source 1..2006: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1529 - RNA, 2006 nt, synthetic construct
  misc_feature 1..2006: note = mRNA product Design g-1 comprising derived and/or modified sequence from HRSV(A2)__F-del_DSCav1 (opt5)
  source 1..2006: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1530 - RNA, 2006 nt, synthetic construct
  misc_feature 1..2006: note = mRNA product Design g-1 comprising derived and/or modified sequence from HRSV(A2)__F-del_DSCav1 (opt6)
  source 1..2006: mol_type = other RNA
gggagactttcccattctgtagcagaatttggtgttgcctgtggtcttggtcccgcggagaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1531 - RNA, 2006 nt, synthetic construct
  misc_feature 1..2006: note = mRNA product Design g-1 comprising derived and/or modified sequence from HRSV(A2)__F-del_DSCav1 (opt11)
  source 1..2006: mol_type = other RNA
gggagactttcccattctgtagcagaatttggtgttgcctgtggtcttggtcccgcggagaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1532 - RNA, 2021 nt, synthetic construct
  misc_feature 1..2021: note = mRNA product Design g-2 comprising derived and/or modified sequence from HRSV(A2)__F-del_DSCav1 (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1533 - RNA, 2021 nt, synthetic construct
  misc_feature 1..2021: note = mRNA product Design g-2 comprising derived and/or modified sequence from HRSV(A2)__F-del_DSCav1 (opt1)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1534 - RNA, 2021 nt, synthetic construct
  misc_feature 1..2021: note = mRNA product Design g-2 comprising derived and/or modified sequence from HRSV(A2)__F-del_DSCav1 (opt2)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1535 - RNA, 2021 nt, synthetic construct
  misc_feature 1..2021: note = mRNA product Design g-2 comprising derived and/or modified sequence from HRSV(A2)__F-del_DSCav1 (opt3)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1536 - RNA, 2021 nt, synthetic construct
  misc_feature 1..2021: note = mRNA product Design g-2 comprising derived and/or modified sequence from HRSV(A2)__F-del_DSCav1 (opt4)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1537 - RNA, 2021 nt, synthetic construct
  misc_feature 1..2021: note = mRNA product Design g-2 comprising derived and/or modified sequence from HRSV(A2)__F-del_DSCav1 (opt5)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1538 - RNA, 2021 nt, synthetic construct
  misc_feature 1..2021: note = mRNA product Design g-2 comprising derived and/or modified sequence from HRSV(A2)__F-del_DSCav1 (opt6)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1539 - RNA, 2021 nt, synthetic construct
  misc_feature 1..2021: note = mRNA product Design g-2 comprising derived and/or modified sequence from HRSV(A2)__F-del_DSCav1 (opt11)
  source 1..2021: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1540 - RNA, 2253 nt, synthetic construct
  misc_feature 1..2253: note = mRNA product Design g-3 comprising derived and/or modified sequence from HRSV(A2)__F-del_DSCav1 (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1541 - RNA, 2253 nt, synthetic construct
  misc_feature 1..2253: note = mRNA product Design g-3 comprising derived and/or modified sequence from HRSV(A2)__F-del_DSCav1 (opt1)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1542 - RNA, 2253 nt, synthetic construct
  misc_feature 1..2253: note = mRNA product Design g-3 comprising derived and/or modified sequence from HRSV(A2)__F-del_DSCav1 (opt2)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1543 - RNA, 2253 nt, synthetic construct
  misc_feature 1..2253: note = mRNA product Design g-3 comprising derived and/or modified sequence from HRSV(A2)__F-del_DSCav1 (opt3)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1544 - RNA, 2253 nt, synthetic construct
  misc_feature 1..2253: note = mRNA product Design g-3 comprising derived and/or modified sequence from HRSV(A2)__F-del_DSCav1 (opt4)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1545 - RNA, 2253 nt, synthetic construct
  misc_feature 1..2253: note = mRNA product Design g-3 comprising derived and/or modified sequence from HRSV(A2)__F-del_DSCav1 (opt5)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1546 - RNA, 2253 nt, synthetic construct
  misc_feature 1..2253: note = mRNA product Design g-3 comprising derived and/or modified sequence from HRSV(A2)__F-del_DSCav1 (opt6)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1547 - RNA, 2253 nt, synthetic construct
  misc_feature 1..2253: note = mRNA product Design g-3 comprising derived and/or modified sequence from HRSV(A2)__F-del_DSCav1 (opt11)
  source 1..2253: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1548 - RNA, 2048 nt, synthetic construct
  misc_feature 1..2048: note = mRNA product Design g-4 comprising derived and/or modified sequence from HRSV(A2)__F-del_DSCav1 (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1549 - RNA, 2048 nt, synthetic construct
  misc_feature 1..2048: note = mRNA product Design g-4 comprising derived and/or modified sequence from HRSV(A2)__F-del_DSCav1 (opt1)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1550 - RNA, 2048 nt, synthetic construct
  misc_feature 1..2048: note = mRNA product Design g-4 comprising derived and/or modified sequence from HRSV(A2)__F-del_DSCav1 (opt2)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1551 - RNA, 2048 nt, synthetic construct
  misc_feature 1..2048: note = mRNA product Design g-4 comprising derived and/or modified sequence from HRSV(A2)__F-del_DSCav1 (opt3)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1552 - RNA, 2048 nt, synthetic construct
  misc_feature 1..2048: note = mRNA product Design g-4 comprising derived and/or modified sequence from HRSV(A2)__F-del_DSCav1 (opt4)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1553 - RNA, 2048 nt, synthetic construct
  misc_feature 1..2048: note = mRNA product Design g-4 comprising derived and/or modified sequence from HRSV(A2)__F-del_DSCav1 (opt5)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1554 - RNA, 2048 nt, synthetic construct
  misc_feature 1..2048: note = mRNA product Design g-4 comprising derived and/or modified sequence from HRSV(A2)__F-del_DSCav1 (opt6)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1555 - RNA, 2048 nt, synthetic construct
  misc_feature 1..2048: note = mRNA product Design g-4 comprising derived and/or modified sequence from HRSV(A2)__F-del_DSCav1 (opt11)
  source 1..2048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1556 - RNA, 2024 nt, synthetic construct
  misc_feature 1..2024: note = mRNA product Design g-5 comprising derived and/or modified sequence from HRSV(A2)__F-del_DSCav1 (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1557 - RNA, 2024 nt, synthetic construct
  misc_feature 1..2024: note = mRNA product Design g-5 comprising derived and/or modified sequence from HRSV(A2)__F-del_DSCav1 (opt1)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1558 - RNA, 2024 nt, synthetic construct
  misc_feature 1..2024: note = mRNA product Design g-5 comprising derived and/or modified sequence from HRSV(A2)__F-del_DSCav1 (opt2)
  source 1..2024: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1559 - RNA, 2024 nt, synthetic construct
  misc_feature 1..2024: note = mRNA product Design g-5 comprising derived and/or modified sequence from HRSV(A2)__F-del_DSCav1 (opt3)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1560 - RNA, 2024 nt, synthetic construct
  misc_feature 1..2024: note = mRNA product Design g-5 comprising derived and/or modified sequence from HRSV(A2)__F-del_DSCav1 (opt4)
  source 1..2024: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1561 - RNA, 2024 nt, synthetic construct
  misc_feature 1..2024: note = mRNA product Design g-5 comprising derived and/or modified sequence from HRSV(A2)__F-del_DSCav1 (opt5)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1562 - RNA, 2024 nt, synthetic construct
  misc_feature 1..2024: note = mRNA product Design g-5 comprising derived and/or modified sequence from HRSV(A2)__F-del_DSCav1 (opt6)
  source 1..2024: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1563 - RNA, 2024 nt, synthetic construct
  misc_feature 1..2024: note = mRNA product Design g-5 comprising derived and/or modified sequence from HRSV(A2)__F-del_DSCav1 (opt11)
  source 1..2024: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1564 - RNA, 2040 nt, synthetic construct
  misc_feature 1..2040: note = mRNA product Design h-1 comprising derived and/or modified sequence from HRSV(A2)__F-del_DSCav1 (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1565 - RNA, 2040 nt, synthetic construct
  misc_feature 1..2040: note = mRNA product Design h-1 comprising derived and/or modified sequence from HRSV(A2)__F-del_DSCav1 (opt1)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1566 - RNA, 2040 nt, synthetic construct
  misc_feature 1..2040: note = mRNA product Design h-1 comprising derived and/or modified sequence from HRSV(A2)__F-del_DSCav1 (opt2)
  source 1..2040: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1567 - RNA, 2040 nt, synthetic construct
  misc_feature 1..2040: note = mRNA product Design h-1 comprising derived and/or modified sequence from HRSV(A2)__F-del_DSCav1 (opt3)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1568 - RNA, 2040 nt, synthetic construct
  misc_feature 1..2040: note = mRNA product Design h-1 comprising derived and/or modified sequence from HRSV(A2)__F-del_DSCav1 (opt4)
  source 1..2040: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1569 - RNA, 2040 nt, synthetic construct
  misc_feature 1..2040: note = mRNA product Design h-1 comprising derived and/or modified sequence from HRSV(A2)__F-del_DSCav1 (opt5)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1570 - RNA, 2040 nt, synthetic construct
  misc_feature 1..2040: note = mRNA product Design h-1 comprising derived and/or modified sequence from HRSV(A2)__F-del_DSCav1 (opt6)
  source 1..2040: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1571 - RNA, 2040 nt, synthetic construct
  misc_feature 1..2040: note = mRNA product Design h-1 comprising derived and/or modified sequence from HRSV(A2)__F-del_DSCav1 (opt11)
  source 1..2040: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1572 - RNA, 2256 nt, synthetic construct
  misc_feature 1..2256: note = mRNA product Design h-2 comprising derived and/or modified sequence from HRSV(A2)__F-del_DSCav1 (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1573 - RNA, 2256 nt, synthetic construct
  misc_feature 1..2256: note = mRNA product Design h-2 comprising derived and/or modified sequence from HRSV(A2)__F-del_DSCav1 (opt1)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1574 - RNA, 2256 nt, synthetic construct
  misc_feature 1..2256: note = mRNA product Design h-2 comprising derived and/or modified sequence from HRSV(A2)__F-del_DSCav1 (opt2)
  source 1..2256: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1575 - RNA, 2256 nt, synthetic construct
  misc_feature 1..2256: note = mRNA product Design h-2 comprising derived and/or modified sequence from HRSV(A2)__F-del_DSCav1 (opt3)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1576 - RNA, 2256 nt, synthetic construct
  misc_feature 1..2256: note = mRNA product Design h-2 comprising derived and/or modified sequence from HRSV(A2)__F-del_DSCav1 (opt4)
  source 1..2256: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1577 - RNA, 2256 nt, synthetic construct
  misc_feature 1..2256: note = mRNA product Design h-2 comprising derived and/or modified sequence from HRSV(A2)__F-del_DSCav1 (opt5)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1578 - RNA, 2256 nt, synthetic construct
  misc_feature 1..2256: note = mRNA product Design h-2 comprising derived and/or modified sequence from HRSV(A2)__F-del_DSCav1 (opt6)
  source 1..2256: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1579 - RNA, 2256 nt, synthetic construct
  misc_feature 1..2256: note = mRNA product Design h-2 comprising derived and/or modified sequence from HRSV(A2)__F-del_DSCav1 (opt11)
  source 1..2256: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1580 - RNA, 2036 nt, synthetic construct
  misc_feature 1..2036: note = mRNA product Design h-3 comprising derived and/or modified sequence from HRSV(A2)__F-del_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1581 - RNA, 2036 nt, synthetic construct
  misc_feature 1..2036: note = mRNA product Design h-3 comprising derived and/or modified sequence from HRSV(A2)__F-del_DSCav1 (opt1)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1582 - RNA, 2036 nt, synthetic construct
  misc_feature 1..2036: note = mRNA product Design h-3 comprising derived and/or modified sequence from HRSV(A2)__F-del_DSCav1 (opt2)
  source 1..2036: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1583 - RNA, 2036 nt, synthetic construct
  misc_feature 1..2036: note = mRNA product Design h-3 comprising derived and/or modified sequence from HRSV(A2)__F-del_DSCav1 (opt3)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1584 - RNA, 2036 nt, synthetic construct
  misc_feature 1..2036: note = mRNA product Design h-3 comprising derived and/or modified sequence from HRSV(A2)__F-del_DSCav1 (opt4)
  source 1..2036: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1585 - RNA, 2036 nt, synthetic construct
  misc_feature 1..2036: note = mRNA product Design h-3 comprising derived and/or modified sequence from HRSV(A2)__F-del_DSCav1 (opt5)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1586 - RNA, 2036 nt, synthetic construct
  misc_feature 1..2036: note = mRNA product Design h-3 comprising derived and/or modified sequence from HRSV(A2)__F-del_DSCav1 (opt6)
  source 1..2036: mol_type = other RNA
gggagacccgtgacccggaagttgtacggctacgcgactttccctcccacaaaccctcgcgcccttcctttcctacttgggcccggcagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1587 - RNA, 2036 nt, synthetic construct
  misc_feature 1..2036: note = mRNA product Design h-3 comprising derived and/or modified sequence from HRSV(A2)__F-del_DSCav1 (opt11)
  source 1..2036: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1588 - RNA, 2099 nt, synthetic construct
  misc_feature 1..2099: note = mRNA product Design h-4 comprising derived and/or modified sequence from HRSV(A2)__F-del_DSCav1 (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1589 - RNA, 2099 nt, synthetic construct
  misc_feature 1..2099: note = mRNA product Design h-4 comprising derived and/or modified sequence from HRSV(A2)__F-del_DSCav1 (opt1)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1590 - RNA, 2099 nt, synthetic construct
  misc_feature 1..2099: note = mRNA product Design h-4 comprising derived and/or modified sequence from HRSV(A2)__F-del_DSCav1 (opt2)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1591 - RNA, 2099 nt, synthetic construct
  misc_feature 1..2099: note = mRNA product Design h-4 comprising derived and/or modified sequence from HRSV(A2)__F-del_DSCav1 (opt3)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1592 - RNA, 2099 nt, synthetic construct
  misc_feature 1..2099: note = mRNA product Design h-4 comprising derived and/or modified sequence from HRSV(A2)__F-del_DSCav1 (opt4)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1593 - RNA, 2099 nt, synthetic construct
  misc_feature 1..2099: note = mRNA product Design h-4 comprising derived and/or modified sequence from HRSV(A2)__F-del_DSCav1 (opt5)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1594 - RNA, 2099 nt, synthetic construct
  misc_feature 1..2099: note = mRNA product Design h-4 comprising derived and/or modified sequence from HRSV(A2)__F-del_DSCav1 (opt6)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1595 - RNA, 2099 nt, synthetic construct
  misc_feature 1..2099: note = mRNA product Design h-4 comprising derived and/or modified sequence from HRSV(A2)__F-del_DSCav1 (opt11)
  source 1..2099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1596 - RNA, 2115 nt, synthetic construct
  misc_feature 1..2115: note = mRNA product Design h-5 comprising derived and/or modified sequence from HRSV(A2)__F-del_DSCav1 (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1597 - RNA, 2115 nt, synthetic construct
  misc_feature 1..2115: note = mRNA product Design h-5 comprising derived and/or modified sequence from HRSV(A2)__F-del_DSCav1 (opt1)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1598 - RNA, 2115 nt, synthetic construct
  misc_feature 1..2115: note = mRNA product Design h-5 comprising derived and/or modified sequence from HRSV(A2)__F-del_DSCav1 (opt2)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1599 - RNA, 2115 nt, synthetic construct
  misc_feature 1..2115: note = mRNA product Design h-5 comprising derived and/or modified sequence from HRSV(A2)__F-del_DSCav1 (opt3)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1600 - RNA, 2115 nt, synthetic construct
  misc_feature 1..2115: note = mRNA product Design h-5 comprising derived and/or modified sequence from HRSV(A2)__F-del_DSCav1 (opt4)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1601 - RNA, 2115 nt, synthetic construct
  misc_feature 1..2115: note = mRNA product Design h-5 comprising derived and/or modified sequence from HRSV(A2)__F-del_DSCav1 (opt5)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1602 - RNA, 2115 nt, synthetic construct
  misc_feature 1..2115: note = mRNA product Design h-5 comprising derived and/or modified sequence from HRSV(A2)__F-del_DSCav1 (opt6)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1603 - RNA, 2115 nt, synthetic construct
  misc_feature 1..2115: note = mRNA product Design h-5 comprising derived and/or modified sequence from HRSV(A2)__F-del_DSCav1 (opt11)
  source 1..2115: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1604 - RNA, 2048 nt, synthetic construct
  misc_feature 1..2048: note = mRNA product Design i-1 comprising derived and/or modified sequence from HRSV(A2)__F-del_DSCav1 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1605 - RNA, 2048 nt, synthetic construct
  misc_feature 1..2048: note = mRNA product Design i-1 comprising derived and/or modified sequence from HRSV(A2)__F-del_DSCav1 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1606 - RNA, 2048 nt, synthetic construct
  misc_feature 1..2048: note = mRNA product Design i-1 comprising derived and/or modified sequence from HRSV(A2)__F-del_DSCav1 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1607 - RNA, 2048 nt, synthetic construct
  misc_feature 1..2048: note = mRNA product Design i-1 comprising derived and/or modified sequence from HRSV(A2)__F-del_DSCav1 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1608 - RNA, 2048 nt, synthetic construct
  misc_feature 1..2048: note = mRNA product Design i-1 comprising derived and/or modified sequence from HRSV(A2)__F-del_DSCav1 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1609 - RNA, 2048 nt, synthetic construct
  misc_feature 1..2048: note = mRNA product Design i-1 comprising derived and/or modified sequence from HRSV(A2)__F-del_DSCav1 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1610 - RNA, 2048 nt, synthetic construct
  misc_feature 1..2048: note = mRNA product Design i-1 comprising derived and/or modified sequence from HRSV(A2)__F-del_DSCav1 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1611 - RNA, 2048 nt, synthetic construct
  misc_feature 1..2048: note = mRNA product Design i-1 comprising derived and/or modified sequence from HRSV(A2)__F-del_DSCav1 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1612 - RNA, 2048 nt, synthetic construct
  misc_feature 1..2048: note = mRNA product Design i-2 comprising derived and/or modified sequence from HRSV(A2)__F-del_DSCav1 (opt1)
  source 1..2048: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1613 - RNA, 2048 nt, synthetic construct
  misc_feature 1..2048: note = mRNA product Design i-2 comprising derived and/or modified sequence from HRSV(A2)__F-del_DSCav1 (opt1)
  source 1..2048: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1614 - RNA, 2048 nt, synthetic construct
  misc_feature 1..2048: note = mRNA product Design i-2 comprising derived and/or modified sequence from HRSV(A2)__F-del_DSCav1 (opt2)
  source 1..2048: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1615 - RNA, 2048 nt, synthetic construct
  misc_feature 1..2048: note = mRNA product Design i-2 comprising derived and/or modified sequence from HRSV(A2)__F-del_DSCav1 (opt3)
  source 1..2048: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1616 - RNA, 2048 nt, synthetic construct
  misc_feature 1..2048: note = mRNA product Design i-2 comprising derived and/or modified sequence from HRSV(A2)__F-del_DSCav1 (opt4)
  source 1..2048: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1617 - RNA, 2048 nt, synthetic construct
  misc_feature 1..2048: note = mRNA product Design i-2 comprising derived and/or modified sequence from HRSV(A2)__F-del_DSCav1 (opt5)
  source 1..2048: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1618 - RNA, 2048 nt, synthetic construct
  misc_feature 1..2048: note = mRNA product Design i-2 comprising derived and/or modified sequence from HRSV(A2)__F-del_DSCav1 (opt6)
  source 1..2048: mol_type = other RNA
gggagaggcgctgcctacggaggtggcagccatctccttctcggcatcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1619 - RNA, 2048 nt, synthetic construct
  misc_feature 1..2048: note = mRNA product Design i-2 comprising derived and/or modified sequence from HRSV(A2)__F-del_DSCav1 (opt11)
  source 1..2048: mol_type = other RNA
gggagaggcgctgcctacggaggtggcagccatctccttctcggcatcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1620 - RNA, 2044 nt, synthetic construct
  misc_feature 1..2044: note = mRNA product Design i-2 comprising derived and/or modified sequence from HRSV(A2)__F-del_DSCav1 (opt1) R6122
  source 1..2044: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1621 - RNA, 2044 nt, synthetic construct
  misc_feature 1..2044: note = mRNA product Design i-2 comprising derived and/or modified sequence from HRSV(A2)__F-del_DSCav1 (opt1)
  source 1..2044: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1622 - RNA, 2044 nt, synthetic construct
  misc_feature 1..2044: note = mRNA product Design i-2 comprising derived and/or modified sequence from HRSV(A2)__F-del_DSCav1 (opt2)
  source 1..2044: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1623 - RNA, 2044 nt, synthetic construct
  misc_feature 1..2044: note = mRNA product Design i-2 comprising derived and/or modified sequence from HRSV(A2)__F-del_DSCav1 (opt3)
  source 1..2044: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1624 - RNA, 2044 nt, synthetic construct
  misc_feature 1..2044: note = mRNA product Design i-2 comprising derived and/or modified sequence from HRSV(A2)__F-del_DSCav1 (opt4)
  source 1..2044: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1625 - RNA, 2044 nt, synthetic construct
  misc_feature 1..2044: note = mRNA product Design i-2 comprising derived and/or modified sequence from HRSV(A2)__F-del_DSCav1 (opt5)
  source 1..2044: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1626 - RNA, 2044 nt, synthetic construct
  misc_feature 1..2044: note = mRNA product Design i-2 comprising derived and/or modified sequence from HRSV(A2)__F-del_DSCav1 (opt6)
  source 1..2044: mol_type = other RNA
ggggcgctgcctacggaggtggcagccatctccttctcggcatcaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1627 - RNA, 2044 nt, synthetic construct
  misc_feature 1..2044: note = mRNA product Design i-2 comprising derived and/or modified sequence from HRSV(A2)__F-del_DSCav1 (opt11)
  source 1..2044: mol_type = other RNA
ggggcgctgcctacggaggtggcagccatctccttctcggcatcaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1628 - RNA, 1879 nt, synthetic construct
  misc_feature 1..1879: note = mRNA product Design i-3 comprising derived and/or modified sequence from HRSV(A2)__F-del_DSCav1 (opt1) R5453
  source 1..1879: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccaacaaccgcgcccggcgcgagctgccccggttcatgaactacaccctcaacaacgccaagaagacgaacgtgaccctgagcaagaagcgcaagcggcgcttcctgggcttcctcctgggggtgggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1629 - RNA, 1879 nt, synthetic construct
  misc_feature 1..1879: note = mRNA product Design i-3 comprising derived and/or modified sequence from HRSV(A2)__F-del_DSCav1 (opt1)
  source 1..1879: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccaacaaccgggcccgccgggagctgccgcgcttcatgaactacaccctcaacaacgccaagaagacgaacgtgaccctgagcaagaagcggaagcgccggttcctgggcttcctcctgggggtgggctccgcgatcgccagcggcgtcgccgtgtgcaaggtgctgcacctcgagggggaggtcaacaagatcaagtccgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccgcctgctggagatcacccgggagttctccgtgaacgcgggggtgaccacccccgtcagcacgtacatgctcaccaacagcgagctgctgtccctcatcaacgacatgcccatcaccaacgaccagaagaagctgatgagcaacaacgtgcagatcgtgcgccagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggagcaacatctgcctgacgcggaccgaccgcggctggtactgcgacaacgccggctccgtgagcttcttcccccaggccgagacctgcaaggtccagtccaaccgggtgttctgcgacaccatgaacagcctgacgctcccgtccgaggtgaacctgtgcaacgtcgacatcttcaaccccaagtacgactgcaagatcatgaccagcaagaccgacgtgtccagctccgtgatcaccagcctgggggccatcgtctcctgctacggcaagacgaagtgcaccgcgagcaacaagaaccgcgggatcatcaagaccttctccaacggctgcgactacgtgagcaacaagggcgtggacaccgtcagcgtggggaacaccctctactacgtgaacaagcaggagggcaagtccctgtacgtcaagggggagcccatcatcaacttctacgaccccctggtgttcccgagcgacgagttcgacgcctccatcagccaggtgaacgagaagatcaaccagtccctcgccttcatccggaagtccgacgagctgctgcacaacgtcaacgccggcaagtccacgaccaacatcatgatcaccaccatcatcatcgtgatcatcgtgatcctgctcagcctgatcgccgtcgggctgctcctgtactgcaaggcgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1630 - RNA, 1879 nt, synthetic construct
  misc_feature 1..1879: note = mRNA product Design i-3 comprising derived and/or modified sequence from HRSV(A2)__F-del_DSCav1 (opt2)
  source 1..1879: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccaacaaccgcgcccgccgcgagctcccccgcttcatgaactacaccctcaacaacgccaagaagaccaacgtcaccctctccaagaagcgcaagcgccgcttcctcggcttcctcctcggcgtcggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1631 - RNA, 1879 nt, synthetic construct
  misc_feature 1..1879: note = mRNA product Design i-3 comprising derived and/or modified sequence from HRSV(A2)__F-del_DSCav1 (opt3)
  source 1..1879: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccaacaatagggctcggcgcgagttgcctcgatttatgaactacacgctcaataacgcaaagaaaactaatgtgaccctgtcgaagaaacgtaagagaaggttcctgggctttctcttaggggtcggatcagccatagctagcggcgtggccgtttgtaaggtgctgcaccttgaaggtgaggtcaacaaaatcaagagtgcgttgctgtccacaaataaagcagtggtatctctaagcaacggggtttccgtgctcactttcaaggtcctggaccttaaaaattatattgataagcaactgttgccaatcctcaacaaacagtcatgcagtattagcaacatcgaaaccgtgatagagtttcagcagaagaataaccggctgttagagattacacgcgagttctctgtgaatgccggagtcaccacgccggtttccacttacatgctgacaaactcagaactccttagcctgatcaatgacatgcccattaccaacgatcaaaagaaattgatgagtaataacgtgcagatcgtaagacagcagtcttattccatcatgtgtattataaaggaagaggtgctagcttacgtcgtgcaactgcctctctacggcgttatcgacactccatgctggaaactgcatacaagccccctttgtaccacgaataccaaggaaggctcgaacatttgcctgacaaggactgatcgggggtggtattgtgacaatgccggatctgtgtcctttttccctcaggcagagacctgcaaagtccagtcaaaccgcgtgttttgtgatacaatgaatagtttgactctcccaagcgaggtaaacctgtgcaatgttgacatcttcaaccccaagtacgattgcaagataatgacctccaaaacagacgtgtctagctcagtcattaccagtttaggtgctatcgtgtcctgttatggcaagactaaatgcacggccagcaacaagaatcgagggatcattaaaacattttctaacggatgtgattacgtctcaaataagggcgtggacaccgttagtgtgggtaacactctgtattacgtaaataagcaagaagggaaaagcctatatgtcaagggagagcctatcattaacttctacgacccactcgtgttcccgtccgatgaatttgacgcgtctatatcgcaggttaatgagaaaatcaaccagagcctggccttcattagaaagtccgatgaacttttgcacaatgtgaacgcaggcaaatcaaccacaaatatcatgatcaccactattataatcgtcattatcgtgattctgctcagtctgatcgctgtaggccttctgttgtactgcaaggccaggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1632 - RNA, 1879 nt, synthetic construct
  misc_feature 1..1879: note = mRNA product Design i-3 comprising derived and/or modified sequence from HRSV(A2)__F-del_DSCav1 (opt4)
  source 1..1879: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccaacaacagagccagaagagagctgcccagattcatgaactacaccctgaacaacgccaagaagaccaacgtgaccctgagcaagaagagaaagagaagattcctgggcttcctgctgggcgtgggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1633 - RNA, 1879 nt, synthetic construct
  misc_feature 1..1879: note = mRNA product Design i-3 comprising derived and/or modified sequence from HRSV(A2)__F-del_DSCav1 (opt5)
  source 1..1879: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacaaacaatcgggctcgcagagagctccctcggtttatgaactacaccctgaataacgccaagaaaacaaatgtcaccctttctaagaaacgcaagagacggttcctggggtttctcctgggagtgggcagcgcgattgcctccggggttgctgtgtgtaaggtccttcacctggaaggagaggtgaacaaaatcaagagcgccctcctgtctacgaataaagctgttgtgtccctgagcaacggcgtctctgtgctcacattcaaggtgctggaccttaaaaattatattgataagcaactgctcccgatcctgaacaaacagtcctgcagcatttctaacatcgaaaccgtcattgagtttcagcagaagaataaccgccttctggagatcacaagagaattttccgttaatgccggcgtgaccacccccgtgagcacatacatgctcacgaactccgagctgctgtctctcatcaatgacatgcctattaccaacgatcaaaagaaactgatgagcaataacgtccagatcgtgcggcagcagtcctatagcattatgtgtatcattaaggaagaggttcttgcgtacgtggtccaactgcccctctacggggtgatcgacacaccttgctggaaactgcatacctctcccctttgtacaaccaatacgaaggaaggatccaacatctgcctgacacgcaccgatagaggctggtattgtgacaatgccgggagcgtttctttcttccctcaggctgagacctgcaaagtgcagagcaaccgggtcttttgtgatacaatgaactccctcaccctgccgtctgaggtgaatctgtgcaatgtcgacattttcaaccccaagtacgattgcaagatcatgacaagcaaaacggacgtgtccagctctgttattacctccctcggagccatcgtgagctgttatggcaagacaaaatgcaccgcttctaacaagaatcgcgggattatcaaaacattttccaacggatgtgattacgtcagcaataagggcgtggacaccgtttccgtgggcaacacgctgtattacgtcaataagcaagaagggaaatctctttatgtgaagggagagcctatcattaacttctacgaccccctggtgttccctagcgatgaatttgacgcctccatctctcaggttaatgagaaaattaaccagagcctcgccttcatcagaaagtccgatgaactgctgcacaatgtcaacgctggcaaaagcaccacaaatattatgatcaccacaattatcatcgtgattatcgtgattcttctctctctgatcgcggtcgggctgctcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1634 - RNA, 1879 nt, synthetic construct
  misc_feature 1..1879: note = mRNA product Design i-3 comprising derived and/or modified sequence from HRSV(A2)__F-del_DSCav1 (opt6)
  source 1..1879: mol_type = other RNA
gggagaaagcttaccatggaactattaatattaaaagcaaatgctattaccacaatacttactgctgtaaccttctgctttgcctctggccaaaacataacagaagaattttatcaatcaacttgctccgctgtaagcaaaggctacctatcagcattacgcaccggctggtacacatcagtaataacaatagaactatccaacataaaagaaaataaatgcaacggaacagacgcaaaagtaaaattaataaaacaagaactcgacaaatacaaaaacgcagtaacagaattacaactactaatgcaaagtactccagccaccaacaacagagcaagaagagaattaccacgatttatgaactacacactaaacaatgcaaaaaaaacaaacgtaacactatcaaaaaaacgtaaacgcagattcttaggcttcctcctaggtgtaggctcagcaatcgcctcaggagtggcagtttgtaaagtactacacctagaaggagaagtaaacaaaatcaaatctgcccttttatcgacaaacaaagcagtagtatcgttatccaatggagtctcagtattgacattcaaagtattagacctaaaaaattatatagataaacaactcttacctatcttaaataaacaaagctgctcaataagtaacatagaaaccgtaatagaatttcaacaaaaaaacaatagactccttgagatcactcgagaattttcagtaaacgcaggtgtaacaacaccagtaagcacatacatgctaacaaatagtgaactattatctctaattaacgatatgcccataaccaacgatcaaaaaaaactcatgagtaacaacgtacaaatagtaagacaacaatcctatagcataatgtgcattataaaagaagaagtactagcatatgtagtccaactaccactatacggcgtaatagacacaccatgctggaaactacacacctcacccctatgcacaacaaatacaaaagaaggatcaaacatatgcttaaccaggacagacagaggctggtactgcgataacgcaggatctgtttcattcttcccccaagcagaaacatgcaaagtacaatcaaacagagtattttgtgataccatgaactcactcacattaccatccgaagtcaacctctgcaacgtagacatattcaaccccaaatacgactgcaaaataatgacctcaaaaacagatgtatcatcatcagtaatcacatcactaggagctatcgtatcttgttatggaaaaacaaaatgcacagcatccaacaaaaacagaggaattatcaaaacattctcaaatggatgtgactatgtatcaaacaaaggagtagacaccgtaagcgtaggcaatacactatattacgtaaataaacaagaaggaaaatcactatacgtaaaaggtgaaccaataataaacttctatgaccccctagtattcccatcagatgaatttgacgcaagcatatcacaagtcaacgaaaaaataaaccaatcactggcattcattcgcaaatcagatgaacttctccacaacgtaaacgctggtaaaagcactacaaacataatgataacaacaatcatcattgtcataatagttattctattatcactaatcgcagtaggattactactatactgtaaagcgaggtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1635 - RNA, 1879 nt, synthetic construct
  misc_feature 1..1879: note = mRNA product Design i-3 comprising derived and/or modified sequence from HRSV(A2)__F-del_DSCav1 (opt11)
  source 1..1879: mol_type = other RNA
gggagaaagcttaccatggagctgctcatcctgaaggccaacgccatcaccacaatcctgacggcggtgaccttctgcttcgccagcggccagaacatcaccgaggagttctaccagtccacgtgcagcgccgtctccaaggggtacctcagcgccctgcgaaccggctggtacacctccgtgatcaccatcgagctgtcaaacatcaaggagaacaagtgcaacgggaccgatgccaaggttaagctcatcaagcaggagctggacaagtacaagaacgcggtcacggagctgcagctcctgatgcagtccactccggcaaccaacaaccgcgccaggcgcgagctgccccggttcatgaactacaccctcaacaacgccaagaagacgaatgtgaccctgagcaagaagcgcaagcggcgcttcctgggcttcctcctaggggtgggctccgccatcgcgagcggcgtcgccgtgtgcaaggtgttgcacctcgagggggaggtcaacaagatcaagagcgccctgctgtccaccaacaaggccgtggtaagcctctccaacggcgtcagcgttctgaccttcaaggtgctggacctcaagaactatatcgacaagcagctgctgcccatcctgaacaagcagagctgctccatctcaaacatcgaaacggtgattgagttccagcagaagaacaaccggctcctggaaatcacccgcgagttcagcgtgaacgccggggtcaccacccccgtgtccacgtacatgctgaccaacagcgagctcctatccctgatcaacgacatgccgatcaccaacgaccagaagaagctcatgagcaacaacgtgcagatcgtccggcagcagtcctacagcatcatgtgcatcatcaaggaagaggtgctggcgtacgtggtccagctgcccctctacggcgtgatcgacaccccctgctggaagctgcacacgagccccctgtgcacaaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgccctctgaggtaaacctctgcaacgtcgacatcttcaaccccaagtacgactgcaagatcatgacctccaagacagacgtgagctccagcgtgatcacatccctgggggccatcgtcagctgctacggcaagactaagtgtactgccagcaacaagaaccgggggatcatcaagaccttctccaacggctgcgactacgtgagcaacaagggcgtggacaccgtgtccgtcgggaacaccctgtactacgttaataagcaggagggcaagagcctctacgtgaaaggggagcccatcattaacttctacgacccactggttttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtgatcatcgtgattctgctgtccctcatcgccgtggggctgctgctttactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1636 - protein, 535 aa, synthetic construct
  REGION 1..535: note = derived and/or modified protein sequence (artificial) from HRSV(A2)__F_DSCav1_mut1
MELLILKANAITTILTAVTFCFASGQNITEEFYQSTCSAVSKGYLGALRTGWYTSVITIELSNIKENKCNGTDAKVKLIKQELDKYKNAVTELQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 1637 - RNA, 1608 nt, synthetic construct
  misc_feature 1..1608: note = derived and/or modified CDS sequence (opt1) from HRSV(A2)__F_DSCav1_mut1
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 1638 - RNA, 1608 nt, synthetic construct
  misc_feature 1..1608: note = derived and/or modified CDS sequence (opt1) from HRSV(A2)__F_DSCav1_mut1
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactga

SEQ ID NO: 1639 - RNA, 1608 nt, synthetic construct
  misc_feature 1..1608: note = derived and/or modified CDS sequence (opt2) from HRSV(A2)__F_DSCav1_mut1
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 1640 - RNA, 1608 nt, synthetic construct
  misc_feature 1..1608: note = derived and/or modified CDS sequence (opt3) from HRSV(A2)__F_DSCav1_mut1
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactga

SEQ ID NO: 1641 - RNA, 1608 nt, synthetic construct
  misc_feature 1..1608: note = derived and/or modified CDS sequence (opt4) from HRSV(A2)__F_DSCav1_mut1
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 1642 - RNA, 1608 nt, synthetic construct
  misc_feature 1..1608: note = derived and/or modified CDS sequence (opt5) from HRSV(A2)__F_DSCav1_mut1
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactga

SEQ ID NO: 1643 - RNA, 1608 nt, synthetic construct
  misc_feature 1..1608: note = derived and/or modified CDS sequence (opt6) from HRSV(A2)__F_DSCav1_mut1
  source 1..1608: mol_type = other RNA
atggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactga

SEQ ID NO: 1644 - RNA, 1608 nt, synthetic construct
  misc_feature 1..1608: note = derived and/or modified CDS sequence (opt11) from HRSV(A2)__F_DSCav1_mut1
  source 1..1608: mol_type = other RNA
atggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaa

SEQ ID NO: 1645 - RNA, 1884 nt, synthetic construct
  misc_feature 1..1884: note = mRNA product Design a-1 comprising derived and/or modified sequence from HRSV(A2)__F_DSCav1_mut1 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1646 - RNA, 1884 nt, synthetic construct
  misc_feature 1..1884: note = mRNA product Design a-1 comprising derived and/or modified sequence from HRSV(A2)__F_DSCav1_mut1 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1647 - RNA, 1884 nt, synthetic construct
  misc_feature 1..1884: note = mRNA product Design a-1 comprising derived and/or modified sequence from HRSV(A2)__F_DSCav1_mut1 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1648 - RNA, 1884 nt, synthetic construct
  misc_feature 1..1884: note = mRNA product Design a-1 comprising derived and/or modified sequence from HRSV(A2)__F_DSCav1_mut1 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1649 - RNA, 1884 nt, synthetic construct
  misc_feature 1..1884: note = mRNA product Design a-1 comprising derived and/or modified sequence from HRSV(A2)__F_DSCav1_mut1 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1650 - RNA, 1884 nt, synthetic construct
  misc_feature 1..1884: note = mRNA product Design a-1 comprising derived and/or modified sequence from HRSV(A2)__F_DSCav1_mut1 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1651 - RNA, 1884 nt, synthetic construct
  misc_feature 1..1884: note = mRNA product Design a-1 comprising derived and/or modified sequence from HRSV(A2)__F_DSCav1_mut1 (opt6)
  source 1..1884: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1652 - RNA, 1884 nt, synthetic construct
  misc_feature 1..1884: note = mRNA product Design a-1 comprising derived and/or modified sequence from HRSV(A2)__F_DSCav1_mut1 (opt11)
  source 1..1884: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1653 - RNA, 1903 nt, synthetic construct
  misc_feature 1..1903: note = mRNA product Design a-2 comprising derived and/or modified sequence from HRSV(A2)__F_DSCav1_mut1 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1654 - RNA, 1903 nt, synthetic construct
  misc_feature 1..1903: note = mRNA product Design a-2 comprising derived and/or modified sequence from HRSV(A2)__F_DSCav1_mut1 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1655 - RNA, 1903 nt, synthetic construct
  misc_feature 1..1903: note = mRNA product Design a-2 comprising derived and/or modified sequence from HRSV(A2)__F_DSCav1_mut1 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1656 - RNA, 1903 nt, synthetic construct
  misc_feature 1..1903: note = mRNA product Design a-2 comprising derived and/or modified sequence from HRSV(A2)__F_DSCav1_mut1 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1657 - RNA, 1903 nt, synthetic construct
  misc_feature 1..1903: note = mRNA product Design a-2 comprising derived and/or modified sequence from HRSV(A2)__F_DSCav1_mut1 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1658 - RNA, 1903 nt, synthetic construct
  misc_feature 1..1903: note = mRNA product Design a-2 comprising derived and/or modified sequence from HRSV(A2)__F_DSCav1_mut1 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1659 - RNA, 1903 nt, synthetic construct
  misc_feature 1..1903: note = mRNA product Design a-2 comprising derived and/or modified sequence from HRSV(A2)__F_DSCav1_mut1 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1660 - RNA, 1903 nt, synthetic construct
  misc_feature 1..1903: note = mRNA product Design a-2 comprising derived and/or modified sequence from HRSV(A2)__F_DSCav1_mut1 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1661 - RNA, 1981 nt, synthetic construct
  misc_feature 1..1981: note = mRNA product Design a-3 comprising derived and/or modified sequence from HRSV(A2)__F_DSCav1_mut1 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1662 - RNA, 1981 nt, synthetic construct
  misc_feature 1..1981: note = mRNA product Design a-3 comprising derived and/or modified sequence from HRSV(A2)__F_DSCav1_mut1 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1663 - RNA, 1981 nt, synthetic construct
  misc_feature 1..1981: note = mRNA product Design a-3 comprising derived and/or modified sequence from HRSV(A2)__F_DSCav1_mut1 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1664 - RNA, 1981 nt, synthetic construct
  misc_feature 1..1981: note = mRNA product Design a-3 comprising derived and/or modified sequence from HRSV(A2)__F_DSCav1_mut1 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1665 - RNA, 1981 nt, synthetic construct
  misc_feature 1..1981: note = mRNA product Design a-3 comprising derived and/or modified sequence from HRSV(A2)__F_DSCav1_mut1 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1666 - RNA, 1981 nt, synthetic construct
  misc_feature 1..1981: note = mRNA product Design a-3 comprising derived and/or modified sequence from HRSV(A2)__F_DSCav1_mut1 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1667 - RNA, 1981 nt, synthetic construct
  misc_feature 1..1981: note = mRNA product Design a-3 comprising derived and/or modified sequence from HRSV(A2)__F_DSCav1_mut1 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1668 - RNA, 1981 nt, synthetic construct
  misc_feature 1..1981: note = mRNA product Design a-3 comprising derived and/or modified sequence from HRSV(A2)__F_DSCav1_mut1 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1669 - RNA, 1930 nt, synthetic construct
  misc_feature 1..1930: note = mRNA product Design a-4 comprising derived and/or modified sequence from HRSV(A2)__F_DSCav1_mut1 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1670 - RNA, 1930 nt, synthetic construct
  misc_feature 1..1930: note = mRNA product Design a-4 comprising derived and/or modified sequence from HRSV(A2)__F_DSCav1_mut1 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1671 - RNA, 1930 nt, synthetic construct
  misc_feature 1..1930: note = mRNA product Design a-4 comprising derived and/or modified sequence from HRSV(A2)__F_DSCav1_mut1 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1672 - RNA, 1930 nt, synthetic construct
  misc_feature 1..1930: note = mRNA product Design a-4 comprising derived and/or modified sequence from HRSV(A2)__F_DSCav1_mut1 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1673 - RNA, 1930 nt, synthetic construct
  misc_feature 1..1930: note = mRNA product Design a-4 comprising derived and/or modified sequence from HRSV(A2)__F_DSCav1_mut1 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1674 - RNA, 1930 nt, synthetic construct
  misc_feature 1..1930: note = mRNA product Design a-4 comprising derived and/or modified sequence from HRSV(A2)__F_DSCav1_mut1 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1675 - RNA, 1930 nt, synthetic construct
  misc_feature 1..1930: note = mRNA product Design a-4 comprising derived and/or modified sequence from HRSV(A2)__F_DSCav1_mut1 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1676 - RNA, 1930 nt, synthetic construct
  misc_feature 1..1930: note = mRNA product Design a-4 comprising derived and/or modified sequence from HRSV(A2)__F_DSCav1_mut1 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1677 - RNA, 1876 nt, synthetic construct
  misc_feature 1..1876: note = mRNA product Design a-5 comprising derived and/or modified sequence from HRSV(A2)__F_DSCav1_mut1 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1678 - RNA, 1876 nt, synthetic construct
  misc_feature 1..1876: note = mRNA product Design a-5 comprising derived and/or modified sequence from HRSV(A2)__F_DSCav1_mut1 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1679 - RNA, 1876 nt, synthetic construct
  misc_feature 1..1876: note = mRNA product Design a-5 comprising derived and/or modified sequence from HRSV(A2)__F_DSCav1_mut1 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1680 - RNA, 1876 nt, synthetic construct
  misc_feature 1..1876: note = mRNA product Design a-5 comprising derived and/or modified sequence from HRSV(A2)__F_DSCav1_mut1 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1681 - RNA, 1876 nt, synthetic construct
  misc_feature 1..1876: note = mRNA product Design a-5 comprising derived and/or modified sequence from HRSV(A2)__F_DSCav1_mut1 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1682 - RNA, 1876 nt, synthetic construct
  misc_feature 1..1876: note = mRNA product Design a-5 comprising derived and/or modified sequence from HRSV(A2)__F_DSCav1_mut1 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1683 - RNA, 1876 nt, synthetic construct
  misc_feature 1..1876: note = mRNA product Design a-5 comprising derived and/or modified sequence from HRSV(A2)__F_DSCav1_mut1 (opt6)
  source 1..1876: mol_type = other RNA
gggagactttcccattctgtagcagaatttggtgttgcctgtggtcttggtcccgcggagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1684 - RNA, 1876 nt, synthetic construct
  misc_feature 1..1876: note = mRNA product Design a-5 comprising derived and/or modified sequence from HRSV(A2)__F_DSCav1_mut1 (opt11)
  source 1..1876: mol_type = other RNA
gggagactttcccattctgtagcagaatttggtgttgcctgtggtcttggtcccgcggagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1685 - RNA, 2057 nt, synthetic construct
  misc_feature 1..2057: note = mRNA product Design b-1 comprising derived and/or modified sequence from HRSV(A2)__F_DSCav1_mut1 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1686 - RNA, 2057 nt, synthetic construct
  misc_feature 1..2057: note = mRNA product Design b-1 comprising derived and/or modified sequence from HRSV(A2)__F_DSCav1_mut1 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1687 - RNA, 2057 nt, synthetic construct
  misc_feature 1..2057: note = mRNA product Design b-1 comprising derived and/or modified sequence from HRSV(A2)__F_DSCav1_mut1 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1688 - RNA, 2057 nt, synthetic construct
  misc_feature 1..2057: note = mRNA product Design b-1 comprising derived and/or modified sequence from HRSV(A2)__F_DSCav1_mut1 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1689 - RNA, 2057 nt, synthetic construct
  misc_feature 1..2057: note = mRNA product Design b-1 comprising derived and/or modified sequence from HRSV(A2)__F_DSCav1_mut1 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1690 - RNA, 2057 nt, synthetic construct
  misc_feature 1..2057: note = mRNA product Design b-1 comprising derived and/or modified sequence from HRSV(A2)__F_DSCav1_mut1 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1691 - RNA, 2057 nt, synthetic construct
  misc_feature 1..2057: note = mRNA product Design b-1 comprising derived and/or modified sequence from HRSV(A2)__F_DSCav1_mut1 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1692 - RNA, 2057 nt, synthetic construct
  misc_feature 1..2057: note = mRNA product Design b-1 comprising derived and/or modified sequence from HRSV(A2)__F_DSCav1_mut1 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1693 - RNA, 1877 nt, synthetic construct
  misc_feature 1..1877: note = mRNA product Design b-2 comprising derived and/or modified sequence from HRSV(A2)__F_DSCav1_mut1 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1694 - RNA, 1877 nt, synthetic construct
  misc_feature 1..1877: note = mRNA product Design b-2 comprising derived and/or modified sequence from HRSV(A2)__F_DSCav1_mut1 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1695 - RNA, 1877 nt, synthetic construct
  misc_feature 1..1877: note = mRNA product Design b-2 comprising derived and/or modified sequence from HRSV(A2)__F_DSCav1_mut1 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1696 - RNA, 1877 nt, synthetic construct
  misc_feature 1..1877: note = mRNA product Design b-2 comprising derived and/or modified sequence from HRSV(A2)__F_DSCav1_mut1 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1697 - RNA, 1877 nt, synthetic construct
  misc_feature 1..1877: note = mRNA product Design b-2 comprising derived and/or modified sequence from HRSV(A2)__F_DSCav1_mut1 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1698 - RNA, 1877 nt, synthetic construct
  misc_feature 1..1877: note = mRNA product Design b-2 comprising derived and/or modified sequence from HRSV(A2)__F_DSCav1_mut1 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1699 - RNA, 1877 nt, synthetic construct
  misc_feature 1..1877: note = mRNA product Design b-2 comprising derived and/or modified sequence from HRSV(A2)__F_DSCav1_mut1 (opt6)
  source 1..1877: mol_type = other RNA
gggagagcctctgctggagtccggggagtggcgttggctgctagagcgaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1700 - RNA, 1877 nt, synthetic construct
  misc_feature 1..1877: note = mRNA product Design b-2 comprising derived and/or modified sequence from HRSV(A2)__F_DSCav1_mut1 (opt11)
  source 1..1877: mol_type = other RNA
gggagagcctctgctggagtccggggagtggcgttggctgctagagcgaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1701 - RNA, 1897 nt, synthetic construct
  misc_feature 1..1897: note = mRNA product Design b-3 comprising derived and/or modified sequence from HRSV(A2)__F_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1702 - RNA, 1897 nt, synthetic construct
  misc_feature 1..1897: note = mRNA product Design b-3 comprising derived and/or modified sequence from HRSV(A2)__F_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1703 - RNA, 1897 nt, synthetic construct
  misc_feature 1..1897: note = mRNA product Design b-3 comprising derived and/or modified sequence from HRSV(A2)__F_DSCav1_mut1 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1704 - RNA, 1897 nt, synthetic construct
  misc_feature 1..1897: note = mRNA product Design b-3 comprising derived and/or modified sequence from HRSV(A2)__F_DSCav1_mut1 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1705 - RNA, 1897 nt, synthetic construct
  misc_feature 1..1897: note = mRNA product Design b-3 comprising derived and/or modified sequence from HRSV(A2)__F_DSCav1_mut1 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1706 - RNA, 1897 nt, synthetic construct
  misc_feature 1..1897: note = mRNA product Design b-3 comprising derived and/or modified sequence from HRSV(A2)__F_DSCav1_mut1 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1707 - RNA, 1897 nt, synthetic construct
  misc_feature 1..1897: note = mRNA product Design b-3 comprising derived and/or modified sequence from HRSV(A2)__F_DSCav1_mut1 (opt6)
  source 1..1897: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1708 - RNA, 1897 nt, synthetic construct
  misc_feature 1..1897: note = mRNA product Design b-3 comprising derived and/or modified sequence from HRSV(A2)__F_DSCav1_mut1 (opt11)
  source 1..1897: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1709 - RNA, 1948 nt, synthetic construct
  misc_feature 1..1948: note = mRNA product Design b-4 comprising derived and/or modified sequence from HRSV(A2)__F_DSCav1_mut1 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1710 - RNA, 1948 nt, synthetic construct
  misc_feature 1..1948: note = mRNA product Design b-4 comprising derived and/or modified sequence from HRSV(A2)__F_DSCav1_mut1 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1711 - RNA, 1948 nt, synthetic construct
  misc_feature 1..1948: note = mRNA product Design b-4 comprising derived and/or modified sequence from HRSV(A2)__F_DSCav1_mut1 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1712 - RNA, 1948 nt, synthetic construct
  misc_feature 1..1948: note = mRNA product Design b-4 comprising derived and/or modified sequence from HRSV(A2)__F_DSCav1_mut1 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1713 - RNA, 1948 nt, synthetic construct
  misc_feature 1..1948: note = mRNA product Design b-4 comprising derived and/or modified sequence from HRSV(A2)__F_DSCav1_mut1 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1714 - RNA, 1948 nt, synthetic construct
  misc_feature 1..1948: note = mRNA product Design b-4 comprising derived and/or modified sequence from HRSV(A2)__F_DSCav1_mut1 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1715 - RNA, 1948 nt, synthetic construct
  misc_feature 1..1948: note = mRNA product Design b-4 comprising derived and/or modified sequence from HRSV(A2)__F_DSCav1_mut1 (opt6)
  source 1..1948: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1716 - RNA, 1948 nt, synthetic construct
  misc_feature 1..1948: note = mRNA product Design b-4 comprising derived and/or modified sequence from HRSV(A2)__F_DSCav1_mut1 (opt11)
  source 1..1948: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1717 - RNA, 2010 nt, synthetic construct
  misc_feature 1..2010: note = mRNA product Design b-5 comprising derived and/or modified sequence from HRSV(A2)__F_DSCav1_mut1 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1718 - RNA, 2010 nt, synthetic construct
  misc_feature 1..2010: note = mRNA product Design b-5 comprising derived and/or modified sequence from HRSV(A2)__F_DSCav1_mut1 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1719 - RNA, 2010 nt, synthetic construct
  misc_feature 1..2010: note = mRNA product Design b-5 comprising derived and/or modified sequence from HRSV(A2)__F_DSCav1_mut1 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1720 - RNA, 2010 nt, synthetic construct
  misc_feature 1..2010: note = mRNA product Design b-5 comprising derived and/or modified sequence from HRSV(A2)__F_DSCav1_mut1 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1721 - RNA, 2010 nt, synthetic construct
  misc_feature 1..2010: note = mRNA product Design b-5 comprising derived and/or modified sequence from HRSV(A2)__F_DSCav1_mut1 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1722 - RNA, 2010 nt, synthetic construct
  misc_feature 1..2010: note = mRNA product Design b-5 comprising derived and/or modified sequence from HRSV(A2)__F_DSCav1_mut1 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1723 - RNA, 2010 nt, synthetic construct
  misc_feature 1..2010: note = mRNA product Design b-5 comprising derived and/or modified sequence from HRSV(A2)__F_DSCav1_mut1 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1724 - RNA, 2010 nt, synthetic construct
  misc_feature 1..2010: note = mRNA product Design b-5 comprising derived and/or modified sequence from HRSV(A2)__F_DSCav1_mut1 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1725 - RNA, 1916 nt, synthetic construct
  misc_feature 1..1916: note = mRNA product Design c-1 comprising derived and/or modified sequence from HRSV(A2)__F_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1726 - RNA, 1916 nt, synthetic construct
  misc_feature 1..1916: note = mRNA product Design c-1 comprising derived and/or modified sequence from HRSV(A2)__F_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1727 - RNA, 1916 nt, synthetic construct
  misc_feature 1..1916: note = mRNA product Design c-1 comprising derived and/or modified sequence from HRSV(A2)__F_DSCav1_mut1 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1728 - RNA, 1916 nt, synthetic construct
  misc_feature 1..1916: note = mRNA product Design c-1 comprising derived and/or modified sequence from HRSV(A2)__F_DSCav1_mut1 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1729 - RNA, 1916 nt, synthetic construct
  misc_feature 1..1916: note = mRNA product Design c-1 comprising derived and/or modified sequence from HRSV(A2)__F_DSCav1_mut1 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1730 - RNA, 1916 nt, synthetic construct
  misc_feature 1..1916: note = mRNA product Design c-1 comprising derived and/or modified sequence from HRSV(A2)__F_DSCav1_mut1 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1731 - RNA, 1916 nt, synthetic construct
  misc_feature 1..1916: note = mRNA product Design c-1 comprising derived and/or modified sequence from HRSV(A2)__F_DSCav1_mut1 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1732 - RNA, 1916 nt, synthetic construct
  misc_feature 1..1916: note = mRNA product Design c-1 comprising derived and/or modified sequence from HRSV(A2)__F_DSCav1_mut1 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1733 - RNA, 2006 nt, synthetic construct
  misc_feature 1..2006: note = mRNA product Design c-2 comprising derived and/or modified sequence from HRSV(A2)__F_DSCav1_mut1 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1734 - RNA, 2006 nt, synthetic construct
  misc_feature 1..2006: note = mRNA product Design c-2 comprising derived and/or modified sequence from HRSV(A2)__F_DSCav1_mut1 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1735 - RNA, 2006 nt, synthetic construct
  misc_feature 1..2006: note = mRNA product Design c-2 comprising derived and/or modified sequence from HRSV(A2)__F_DSCav1_mut1 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1736 - RNA, 2006 nt, synthetic construct
  misc_feature 1..2006: note = mRNA product Design c-2 comprising derived and/or modified sequence from HRSV(A2)__F_DSCav1_mut1 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1737 - RNA, 2006 nt, synthetic construct
  misc_feature 1..2006: note = mRNA product Design c-2 comprising derived and/or modified sequence from HRSV(A2)__F_DSCav1_mut1 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1738 - RNA, 2006 nt, synthetic construct
  misc_feature 1..2006: note = mRNA product Design c-2 comprising derived and/or modified sequence from HRSV(A2)__F_DSCav1_mut1 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1739 - RNA, 2006 nt, synthetic construct
  misc_feature 1..2006: note = mRNA product Design c-2 comprising derived and/or modified sequence from HRSV(A2)__F_DSCav1_mut1 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1740 - RNA, 2006 nt, synthetic construct
  misc_feature 1..2006: note = mRNA product Design c-2 comprising derived and/or modified sequence from HRSV(A2)__F_DSCav1_mut1 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1741 - RNA, 1983 nt, synthetic construct
  misc_feature 1..1983: note = mRNA product Design c-3 comprising derived and/or modified sequence from HRSV(A2)__F_DSCav1_mut1 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1742 - RNA, 1983 nt, synthetic construct
  misc_feature 1..1983: note = mRNA product Design c-3 comprising derived and/or modified sequence from HRSV(A2)__F_DSCav1_mut1 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1743 - RNA, 1983 nt, synthetic construct
  misc_feature 1..1983: note = mRNA product Design c-3 comprising derived and/or modified sequence from HRSV(A2)__F_DSCav1_mut1 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1744 - RNA, 1983 nt, synthetic construct
  misc_feature 1..1983: note = mRNA product Design c-3 comprising derived and/or modified sequence from HRSV(A2)__F_DSCav1_mut1 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1745 - RNA, 1983 nt, synthetic construct
  misc_feature 1..1983: note = mRNA product Design c-3 comprising derived and/or modified sequence from HRSV(A2)__F_DSCav1_mut1 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1746 - RNA, 1983 nt, synthetic construct
  misc_feature 1..1983: note = mRNA product Design c-3 comprising derived and/or modified sequence from HRSV(A2)__F_DSCav1_mut1 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1747 - RNA, 1983 nt, synthetic construct
  misc_feature 1..1983: note = mRNA product Design c-3 comprising derived and/or modified sequence from HRSV(A2)__F_DSCav1_mut1 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1748 - RNA, 1983 nt, synthetic construct
  misc_feature 1..1983: note = mRNA product Design c-3 comprising derived and/or modified sequence from HRSV(A2)__F_DSCav1_mut1 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1749 - RNA, 1979 nt, synthetic construct
  misc_feature 1..1979: note = mRNA product Design c-4 comprising derived and/or modified sequence from HRSV(A2)__F_DSCav1_mut1 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1750 - RNA, 1979 nt, synthetic construct
  misc_feature 1..1979: note = mRNA product Design c-4 comprising derived and/or modified sequence from HRSV(A2)__F_DSCav1_mut1 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1751 - RNA, 1979 nt, synthetic construct
  misc_feature 1..1979: note = mRNA product Design c-4 comprising derived and/or modified sequence from HRSV(A2)__F_DSCav1_mut1 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1752 - RNA, 1979 nt, synthetic construct
  misc_feature 1..1979: note = mRNA product Design c-4 comprising derived and/or modified sequence from HRSV(A2)__F_DSCav1_mut1 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1753 - RNA, 1979 nt, synthetic construct
  misc_feature 1..1979: note = mRNA product Design c-4 comprising derived and/or modified sequence from HRSV(A2)__F_DSCav1_mut1 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1754 - RNA, 1979 nt, synthetic construct
  misc_feature 1..1979: note = mRNA product Design c-4 comprising derived and/or modified sequence from HRSV(A2)__F_DSCav1_mut1 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1755 - RNA, 1979 nt, synthetic construct
  misc_feature 1..1979: note = mRNA product Design c-4 comprising derived and/or modified sequence from HRSV(A2)__F_DSCav1_mut1 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1756 - RNA, 1979 nt, synthetic construct
  misc_feature 1..1979: note = mRNA product Design c-4 comprising derived and/or modified sequence from HRSV(A2)__F_DSCav1_mut1 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1757 - RNA, 1897 nt, synthetic construct
  misc_feature 1..1897: note = mRNA product Design c-5 comprising derived and/or modified sequence from HRSV(A2)__F_DSCav1_mut1 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1758 - RNA, 1897 nt, synthetic construct
  misc_feature 1..1897: note = mRNA product Design c-5 comprising derived and/or modified sequence from HRSV(A2)__F_DSCav1_mut1 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1759 - RNA, 1897 nt, synthetic construct
  misc_feature 1..1897: note = mRNA product Design c-5 comprising derived and/or modified sequence from HRSV(A2)__F_DSCav1_mut1 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1760 - RNA, 1897 nt, synthetic construct
  misc_feature 1..1897: note = mRNA product Design c-5 comprising derived and/or modified sequence from HRSV(A2)__F_DSCav1_mut1 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1761 - RNA, 1897 nt, synthetic construct
  misc_feature 1..1897: note = mRNA product Design c-5 comprising derived and/or modified sequence from HRSV(A2)__F_DSCav1_mut1 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1762 - RNA, 1897 nt, synthetic construct
  misc_feature 1..1897: note = mRNA product Design c-5 comprising derived and/or modified sequence from HRSV(A2)__F_DSCav1_mut1 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1763 - RNA, 1897 nt, synthetic construct
  misc_feature 1..1897: note = mRNA product Design c-5 comprising derived and/or modified sequence from HRSV(A2)__F_DSCav1_mut1 (opt6)
  source 1..1897: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1764 - RNA, 1897 nt, synthetic construct
  misc_feature 1..1897: note = mRNA product Design c-5 comprising derived and/or modified sequence from HRSV(A2)__F_DSCav1_mut1 (opt11)
  source 1..1897: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1765 - RNA, 1906 nt, synthetic construct
  misc_feature 1..1906: note = mRNA product Design d-1 comprising derived and/or modified sequence from HRSV(A2)__F_DSCav1_mut1 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1766 - RNA, 1906 nt, synthetic construct
  misc_feature 1..1906: note = mRNA product Design d-1 comprising derived and/or modified sequence from HRSV(A2)__F_DSCav1_mut1 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1767 - RNA, 1906 nt, synthetic construct
  misc_feature 1..1906: note = mRNA product Design d-1 comprising derived and/or modified sequence from HRSV(A2)__F_DSCav1_mut1 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1768 - RNA, 1906 nt, synthetic construct
  misc_feature 1..1906: note = mRNA product Design d-1 comprising derived and/or modified sequence from HRSV(A2)__F_DSCav1_mut1 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1769 - RNA, 1906 nt, synthetic construct
  misc_feature 1..1906: note = mRNA product Design d-1 comprising derived and/or modified sequence from HRSV(A2)__F_DSCav1_mut1 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1770 - RNA, 1906 nt, synthetic construct
  misc_feature 1..1906: note = mRNA product Design d-1 comprising derived and/or modified sequence from HRSV(A2)__F_DSCav1_mut1 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1771 - RNA, 1906 nt, synthetic construct
  misc_feature 1..1906: note = mRNA product Design d-1 comprising derived and/or modified sequence from HRSV(A2)__F_DSCav1_mut1 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1772 - RNA, 1906 nt, synthetic construct
  misc_feature 1..1906: note = mRNA product Design d-1 comprising derived and/or modified sequence from HRSV(A2)__F_DSCav1_mut1 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1773 - RNA, 1961 nt, synthetic construct
  misc_feature 1..1961: note = mRNA product Design d-2 comprising derived and/or modified sequence from HRSV(A2)__F_DSCav1_mut1 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1774 - RNA, 1961 nt, synthetic construct
  misc_feature 1..1961: note = mRNA product Design d-2 comprising derived and/or modified sequence from HRSV(A2)__F_DSCav1_mut1 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1775 - RNA, 1961 nt, synthetic construct
  misc_feature 1..1961: note = mRNA product Design d-2 comprising derived and/or modified sequence from HRSV(A2)__F_DSCav1_mut1 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1776 - RNA, 1961 nt, synthetic construct
  misc_feature 1..1961: note = mRNA product Design d-2 comprising derived and/or modified sequence from HRSV(A2)__F_DSCav1_mut1 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1777 - RNA, 1961 nt, synthetic construct
  misc_feature 1..1961: note = mRNA product Design d-2 comprising derived and/or modified sequence from HRSV(A2)__F_DSCav1_mut1 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1778 - RNA, 1961 nt, synthetic construct
  misc_feature 1..1961: note = mRNA product Design d-2 comprising derived and/or modified sequence from HRSV(A2)__F_DSCav1_mut1 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1779 - RNA, 1961 nt, synthetic construct
  misc_feature 1..1961: note = mRNA product Design d-2 comprising derived and/or modified sequence from HRSV(A2)__F_DSCav1_mut1 (opt6)
  source 1..1961: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1780 - RNA, 1961 nt, synthetic construct
  misc_feature 1..1961: note = mRNA product Design d-2 comprising derived and/or modified sequence from HRSV(A2)__F_DSCav1_mut1 (opt11)
  source 1..1961: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1781 - RNA, 2277 nt, synthetic construct
  misc_feature 1..2277: note = mRNA product Design d-3 comprising derived and/or modified sequence from HRSV(A2)__F_DSCav1_mut1 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1782 - RNA, 2277 nt, synthetic construct
  misc_feature 1..2277: note = mRNA product Design d-3 comprising derived and/or modified sequence from HRSV(A2)__F_DSCav1_mut1 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1783 - RNA, 2277 nt, synthetic construct
  misc_feature 1..2277: note = mRNA product Design d-3 comprising derived and/or modified sequence from HRSV(A2)__F_DSCav1_mut1 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1784 - RNA, 2277 nt, synthetic construct
  misc_feature 1..2277: note = mRNA product Design d-3 comprising derived and/or modified sequence from HRSV(A2)__F_DSCav1_mut1 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1785 - RNA, 2277 nt, synthetic construct
  misc_feature 1..2277: note = mRNA product Design d-3 comprising derived and/or modified sequence from HRSV(A2)__F_DSCav1_mut1 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1786 - RNA, 2277 nt, synthetic construct
  misc_feature 1..2277: note = mRNA product Design d-3 comprising derived and/or modified sequence from HRSV(A2)__F_DSCav1_mut1 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1787 - RNA, 2277 nt, synthetic construct
  misc_feature 1..2277: note = mRNA product Design d-3 comprising derived and/or modified sequence from HRSV(A2)__F_DSCav1_mut1 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1788 - RNA, 2277 nt, synthetic construct
  misc_feature 1..2277: note = mRNA product Design d-3 comprising derived and/or modified sequence from HRSV(A2)__F_DSCav1_mut1 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1789 - RNA, 1960 nt, synthetic construct
  misc_feature 1..1960: note = mRNA product Design d-4 comprising derived and/or modified sequence from HRSV(A2)__F_DSCav1_mut1 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1790 - RNA, 1960 nt, synthetic construct
  misc_feature 1..1960: note = mRNA product Design d-4 comprising derived and/or modified sequence from HRSV(A2)__F_DSCav1_mut1 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1791 - RNA, 1960 nt, synthetic construct
  misc_feature 1..1960: note = mRNA product Design d-4 comprising derived and/or modified sequence from HRSV(A2)__F_DSCav1_mut1 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1792 - RNA, 1960 nt, synthetic construct
  misc_feature 1..1960: note = mRNA product Design d-4 comprising derived and/or modified sequence from HRSV(A2)__F_DSCav1_mut1 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1793 - RNA, 1960 nt, synthetic construct
  misc_feature 1..1960: note = mRNA product Design d-4 comprising derived and/or modified sequence from HRSV(A2)__F_DSCav1_mut1 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1794 - RNA, 1960 nt, synthetic construct
  misc_feature 1..1960: note = mRNA product Design d-4 comprising derived and/or modified sequence from HRSV(A2)__F_DSCav1_mut1 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1795 - RNA, 1960 nt, synthetic construct
  misc_feature 1..1960: note = mRNA product Design d-4 comprising derived and/or modified sequence from HRSV(A2)__F_DSCav1_mut1 (opt6)
  source 1..1960: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1796 - RNA, 1960 nt, synthetic construct
  misc_feature 1..1960: note = mRNA product Design d-4 comprising derived and/or modified sequence from HRSV(A2)__F_DSCav1_mut1 (opt11)
  source 1..1960: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1797 - RNA, 2057 nt, synthetic construct
  misc_feature 1..2057: note = mRNA product Design d-5 comprising derived and/or modified sequence from HRSV(A2)__F_DSCav1_mut1 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1798 - RNA, 2057 nt, synthetic construct
  misc_feature 1..2057: note = mRNA product Design d-5 comprising derived and/or modified sequence from HRSV(A2)__F_DSCav1_mut1 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1799 - RNA, 2057 nt, synthetic construct
  misc_feature 1..2057: note = mRNA product Design d-5 comprising derived and/or modified sequence from HRSV(A2)__F_DSCav1_mut1 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1800 - RNA, 2057 nt, synthetic construct
  misc_feature 1..2057: note = mRNA product Design d-5 comprising derived and/or modified sequence from HRSV(A2)__F_DSCav1_mut1 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1801 - RNA, 2057 nt, synthetic construct
  misc_feature 1..2057: note = mRNA product Design d-5 comprising derived and/or modified sequence from HRSV(A2)__F_DSCav1_mut1 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1802 - RNA, 2057 nt, synthetic construct
  misc_feature 1..2057: note = mRNA product Design d-5 comprising derived and/or modified sequence from HRSV(A2)__F_DSCav1_mut1 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1803 - RNA, 2057 nt, synthetic construct
  misc_feature 1..2057: note = mRNA product Design d-5 comprising derived and/or modified sequence from HRSV(A2)__F_DSCav1_mut1 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1804 - RNA, 2057 nt, synthetic construct
  misc_feature 1..2057: note = mRNA product Design d-5 comprising derived and/or modified sequence from HRSV(A2)__F_DSCav1_mut1 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1805 - RNA, 1937 nt, synthetic construct
  misc_feature 1..1937: note = mRNA product Design e-1 comprising derived and/or modified sequence from HRSV(A2)__F_DSCav1_mut1 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1806 - RNA, 1937 nt, synthetic construct
  misc_feature 1..1937: note = mRNA product Design e-1 comprising derived and/or modified sequence from HRSV(A2)__F_DSCav1_mut1 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1807 - RNA, 1937 nt, synthetic construct
  misc_feature 1..1937: note = mRNA product Design e-1 comprising derived and/or modified sequence from HRSV(A2)__F_DSCav1_mut1 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1808 - RNA, 1937 nt, synthetic construct
  misc_feature 1..1937: note = mRNA product Design e-1 comprising derived and/or modified sequence from HRSV(A2)__F_DSCav1_mut1 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1809 - RNA, 1937 nt, synthetic construct
  misc_feature 1..1937: note = mRNA product Design e-1 comprising derived and/or modified sequence from HRSV(A2)__F_DSCav1_mut1 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1810 - RNA, 1937 nt, synthetic construct
  misc_feature 1..1937: note = mRNA product Design e-1 comprising derived and/or modified sequence from HRSV(A2)__F_DSCav1_mut1 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1811 - RNA, 1937 nt, synthetic construct
  misc_feature 1..1937: note = mRNA product Design e-1 comprising derived and/or modified sequence from HRSV(A2)__F_DSCav1_mut1 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1812 - RNA, 1937 nt, synthetic construct
  misc_feature 1..1937: note = mRNA product Design e-1 comprising derived and/or modified sequence from HRSV(A2)__F_DSCav1_mut1 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1813 - RNA, 1919 nt, synthetic construct
  misc_feature 1..1919: note = mRNA product Design e-2 comprising derived and/or modified sequence from HRSV(A2)__F_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1814 - RNA, 1919 nt, synthetic construct
  misc_feature 1..1919: note = mRNA product Design e-2 comprising derived and/or modified sequence from HRSV(A2)__F_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1815 - RNA, 1919 nt, synthetic construct
  misc_feature 1..1919: note = mRNA product Design e-2 comprising derived and/or modified sequence from HRSV(A2)__F_DSCav1_mut1 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1816 - RNA, 1919 nt, synthetic construct
  misc_feature 1..1919: note = mRNA product Design e-2 comprising derived and/or modified sequence from HRSV(A2)__F_DSCav1_mut1 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1817 - RNA, 1919 nt, synthetic construct
  misc_feature 1..1919: note = mRNA product Design e-2 comprising derived and/or modified sequence from HRSV(A2)__F_DSCav1_mut1 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1818 - RNA, 1919 nt, synthetic construct
  misc_feature 1..1919: note = mRNA product Design e-2 comprising derived and/or modified sequence from HRSV(A2)__F_DSCav1_mut1 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1819 - RNA, 1919 nt, synthetic construct
  misc_feature 1..1919: note = mRNA product Design e-2 comprising derived and/or modified sequence from HRSV(A2)__F_DSCav1_mut1 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1820 - RNA, 1919 nt, synthetic construct
  misc_feature 1..1919: note = mRNA product Design e-2 comprising derived and/or modified sequence from HRSV(A2)__F_DSCav1_mut1 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1821 - RNA, 1889 nt, synthetic construct
  misc_feature 1..1889: note = mRNA product Design e-3 comprising derived and/or modified sequence from HRSV(A2)__F_DSCav1_mut1 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1822 - RNA, 1889 nt, synthetic construct
  misc_feature 1..1889: note = mRNA product Design e-3 comprising derived and/or modified sequence from HRSV(A2)__F_DSCav1_mut1 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1823 - RNA, 1889 nt, synthetic construct
  misc_feature 1..1889: note = mRNA product Design e-3 comprising derived and/or modified sequence from HRSV(A2)__F_DSCav1_mut1 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1824 - RNA, 1889 nt, synthetic construct
  misc_feature 1..1889: note = mRNA product Design e-3 comprising derived and/or modified sequence from HRSV(A2)__F_DSCav1_mut1 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1825 - RNA, 1889 nt, synthetic construct
  misc_feature 1..1889: note = mRNA product Design e-3 comprising derived and/or modified sequence from HRSV(A2)__F_DSCav1_mut1 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1826 - RNA, 1889 nt, synthetic construct
  misc_feature 1..1889: note = mRNA product Design e-3 comprising derived and/or modified sequence from HRSV(A2)__F_DSCav1_mut1 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1827 - RNA, 1889 nt, synthetic construct
  misc_feature 1..1889: note = mRNA product Design e-3 comprising derived and/or modified sequence from HRSV(A2)__F_DSCav1_mut1 (opt6)
  source 1..1889: mol_type = other RNA
gggagactttcccattctgtagcagaatttggtgttgcctgtggtcttggtcccgcggagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1828 - RNA, 1889 nt, synthetic construct
  misc_feature 1..1889: note = mRNA product Design e-3 comprising derived and/or modified sequence from HRSV(A2)__F_DSCav1_mut1 (opt11)
  source 1..1889: mol_type = other RNA
gggagactttcccattctgtagcagaatttggtgttgcctgtggtcttggtcccgcggagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1829 - RNA, 1943 nt, synthetic construct
  misc_feature 1..1943: note = mRNA product Design e-4 comprising derived and/or modified sequence from HRSV(A2)__F_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1830 - RNA, 1943 nt, synthetic construct
  misc_feature 1..1943: note = mRNA product Design e-4 comprising derived and/or modified sequence from HRSV(A2)__F_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1831 - RNA, 1943 nt, synthetic construct
  misc_feature 1..1943: note = mRNA product Design e-4 comprising derived and/or modified sequence from HRSV(A2)__F_DSCav1_mut1 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1832 - RNA, 1943 nt, synthetic construct
  misc_feature 1..1943: note = mRNA product Design e-4 comprising derived and/or modified sequence from HRSV(A2)__F_DSCav1_mut1 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1833 - RNA, 1943 nt, synthetic construct
  misc_feature 1..1943: note = mRNA product Design e-4 comprising derived and/or modified sequence from HRSV(A2)__F_DSCav1_mut1 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1834 - RNA, 1943 nt, synthetic construct
  misc_feature 1..1943: note = mRNA product Design e-4 comprising derived and/or modified sequence from HRSV(A2)__F_DSCav1_mut1 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1835 - RNA, 1943 nt, synthetic construct
  misc_feature 1..1943: note = mRNA product Design e-4 comprising derived and/or modified sequence from HRSV(A2)__F_DSCav1_mut1 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1836 - RNA, 1943 nt, synthetic construct
  misc_feature 1..1943: note = mRNA product Design e-4 comprising derived and/or modified sequence from HRSV(A2)__F_DSCav1_mut1 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1837 - RNA, 1910 nt, synthetic construct
  misc_feature 1..1910: note = mRNA product Design e-5 comprising derived and/or modified sequence from HRSV(A2)__F_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1838 - RNA, 1910 nt, synthetic construct
  misc_feature 1..1910: note = mRNA product Design e-5 comprising derived and/or modified sequence from HRSV(A2)__F_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1839 - RNA, 1910 nt, synthetic construct
  misc_feature 1..1910: note = mRNA product Design e-5 comprising derived and/or modified sequence from HRSV(A2)__F_DSCav1_mut1 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1840 - RNA, 1910 nt, synthetic construct
  misc_feature 1..1910: note = mRNA product Design e-5 comprising derived and/or modified sequence from HRSV(A2)__F_DSCav1_mut1 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1841 - RNA, 1910 nt, synthetic construct
  misc_feature 1..1910: note = mRNA product Design e-5 comprising derived and/or modified sequence from HRSV(A2)__F_DSCav1_mut1 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1842 - RNA, 1910 nt, synthetic construct
  misc_feature 1..1910: note = mRNA product Design e-5 comprising derived and/or modified sequence from HRSV(A2)__F_DSCav1_mut1 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1843 - RNA, 1910 nt, synthetic construct
  misc_feature 1..1910: note = mRNA product Design e-5 comprising derived and/or modified sequence from HRSV(A2)__F_DSCav1_mut1 (opt6)
  source 1..1910: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1844 - RNA, 1910 nt, synthetic construct
  misc_feature 1..1910: note = mRNA product Design e-5 comprising derived and/or modified sequence from HRSV(A2)__F_DSCav1_mut1 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1845 - RNA, 1977 nt, synthetic construct
  misc_feature 1..1977: note = mRNA product Design e-6 comprising derived and/or modified sequence from HRSV(A2)__F_DSCav1_mut1 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1846 - RNA, 1977 nt, synthetic construct
  misc_feature 1..1977: note = mRNA product Design e-6 comprising derived and/or modified sequence from HRSV(A2)__F_DSCav1_mut1 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1847 - RNA, 1977 nt, synthetic construct
  misc_feature 1..1977: note = mRNA product Design e-6 comprising derived and/or modified sequence from HRSV(A2)__F_DSCav1_mut1 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1848 - RNA, 1977 nt, synthetic construct
  misc_feature 1..1977: note = mRNA product Design e-6 comprising derived and/or modified sequence from HRSV(A2)__F_DSCav1_mut1 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1849 - RNA, 1977 nt, synthetic construct
  misc_feature 1..1977: note = mRNA product Design e-6 comprising derived and/or modified sequence from HRSV(A2)__F_DSCav1_mut1 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1850 - RNA, 1977 nt, synthetic construct
  misc_feature 1..1977: note = mRNA product Design e-6 comprising derived and/or modified sequence from HRSV(A2)__F_DSCav1_mut1 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1851 - RNA, 1977 nt, synthetic construct
  misc_feature 1..1977: note = mRNA product Design e-6 comprising derived and/or modified sequence from HRSV(A2)__F_DSCav1_mut1 (opt6)
  source 1..1977: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1852 - RNA, 1977 nt, synthetic construct
  misc_feature 1..1977: note = mRNA product Design e-6 comprising derived and/or modified sequence from HRSV(A2)__F_DSCav1_mut1 (opt11)
  source 1..1977: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1853 - RNA, 2193 nt, synthetic construct
  misc_feature 1..2193: note = mRNA product Design f-1 comprising derived and/or modified sequence from HRSV(A2)__F_DSCav1_mut1 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1854 - RNA, 2193 nt, synthetic construct
  misc_feature 1..2193: note = mRNA product Design f-1 comprising derived and/or modified sequence from HRSV(A2)__F_DSCav1_mut1 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1855 - RNA, 2193 nt, synthetic construct
  misc_feature 1..2193: note = mRNA product Design f-1 comprising derived and/or modified sequence from HRSV(A2)__F_DSCav1_mut1 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1856 - RNA, 2193 nt, synthetic construct
  misc_feature 1..2193: note = mRNA product Design f-1 comprising derived and/or modified sequence from HRSV(A2)__F_DSCav1_mut1 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1857 - RNA, 2193 nt, synthetic construct
  misc_feature 1..2193: note = mRNA product Design f-1 comprising derived and/or modified sequence from HRSV(A2)__F_DSCav1_mut1 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1858 - RNA, 2193 nt, synthetic construct
  misc_feature 1..2193: note = mRNA product Design f-1 comprising derived and/or modified sequence from HRSV(A2)__F_DSCav1_mut1 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1859 - RNA, 2193 nt, synthetic construct
  misc_feature 1..2193: note = mRNA product Design f-1 comprising derived and/or modified sequence from HRSV(A2)__F_DSCav1_mut1 (opt6)
  source 1..2193: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1860 - RNA, 2193 nt, synthetic construct
  misc_feature 1..2193: note = mRNA product Design f-1 comprising derived and/or modified sequence from HRSV(A2)__F_DSCav1_mut1 (opt11)
  source 1..2193: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1861 - RNA, 1973 nt, synthetic construct
  misc_feature 1..1973: note = mRNA product Design f-2 comprising derived and/or modified sequence from HRSV(A2)__F_DSCav1_mut1 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1862 - RNA, 1973 nt, synthetic construct
  misc_feature 1..1973: note = mRNA product Design f-2 comprising derived and/or modified sequence from HRSV(A2)__F_DSCav1_mut1 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1863 - RNA, 1973 nt, synthetic construct
  misc_feature 1..1973: note = mRNA product Design f-2 comprising derived and/or modified sequence from HRSV(A2)__F_DSCav1_mut1 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1864 - RNA, 1973 nt, synthetic construct
  misc_feature 1..1973: note = mRNA product Design f-2 comprising derived and/or modified sequence from HRSV(A2)__F_DSCav1_mut1 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1865 - RNA, 1973 nt, synthetic construct
  misc_feature 1..1973: note = mRNA product Design f-2 comprising derived and/or modified sequence from HRSV(A2)__F_DSCav1_mut1 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1866 - RNA, 1973 nt, synthetic construct
  misc_feature 1..1973: note = mRNA product Design f-2 comprising derived and/or modified sequence from HRSV(A2)__F_DSCav1_mut1 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1867 - RNA, 1973 nt, synthetic construct
  misc_feature 1..1973: note = mRNA product Design f-2 comprising derived and/or modified sequence from HRSV(A2)__F_DSCav1_mut1 (opt6)
  source 1..1973: mol_type = other RNA
gggagagcggctcggccattttgtcccagtcagtccggaggctgcggctgcagaagtaccgcctgcggagtaactgcaaagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1868 - RNA, 1973 nt, synthetic construct
  misc_feature 1..1973: note = mRNA product Design f-2 comprising derived and/or modified sequence from HRSV(A2)__F_DSCav1_mut1 (opt11)
  source 1..1973: mol_type = other RNA
gggagagcggctcggccattttgtcccagtcagtccggaggctgcggctgcagaagtaccgcctgcggagtaactgcaaagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1869 - RNA, 1964 nt, synthetic construct
  misc_feature 1..1964: note = mRNA product Design f-3 comprising derived and/or modified sequence from HRSV(A2)__F_DSCav1_mut1 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1870 - RNA, 1964 nt, synthetic construct
  misc_feature 1..1964: note = mRNA product Design f-3 comprising derived and/or modified sequence from HRSV(A2)__F_DSCav1_mut1 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1871 - RNA, 1964 nt, synthetic construct
  misc_feature 1..1964: note = mRNA product Design f-3 comprising derived and/or modified sequence from HRSV(A2)__F_DSCav1_mut1 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1872 - RNA, 1964 nt, synthetic construct
  misc_feature 1..1964: note = mRNA product Design f-3 comprising derived and/or modified sequence from HRSV(A2)__F_DSCav1_mut1 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1873 - RNA, 1964 nt, synthetic construct
  misc_feature 1..1964: note = mRNA product Design f-3 comprising derived and/or modified sequence from HRSV(A2)__F_DSCav1_mut1 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1874 - RNA, 1964 nt, synthetic construct
  misc_feature 1..1964: note = mRNA product Design f-3 comprising derived and/or modified sequence from HRSV(A2)__F_DSCav1_mut1 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1875 - RNA, 1964 nt, synthetic construct
  misc_feature 1..1964: note = mRNA product Design f-3 comprising derived and/or modified sequence from HRSV(A2)__F_DSCav1_mut1 (opt6)
  source 1..1964: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1876 - RNA, 1964 nt, synthetic construct
  misc_feature 1..1964: note = mRNA product Design f-3 comprising derived and/or modified sequence from HRSV(A2)__F_DSCav1_mut1 (opt11)
  source 1..1964: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1877 - RNA, 2180 nt, synthetic construct
  misc_feature 1..2180: note = mRNA product Design f-4 comprising derived and/or modified sequence from HRSV(A2)__F_DSCav1_mut1 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1878 - RNA, 2180 nt, synthetic construct
  misc_feature 1..2180: note = mRNA product Design f-4 comprising derived and/or modified sequence from HRSV(A2)__F_DSCav1_mut1 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1879 - RNA, 2180 nt, synthetic construct
  misc_feature 1..2180: note = mRNA product Design f-4 comprising derived and/or modified sequence from HRSV(A2)__F_DSCav1_mut1 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1880 - RNA, 2180 nt, synthetic construct
  misc_feature 1..2180: note = mRNA product Design f-4 comprising derived and/or modified sequence from HRSV(A2)__F_DSCav1_mut1 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1881 - RNA, 2180 nt, synthetic construct
  misc_feature 1..2180: note = mRNA product Design f-4 comprising derived and/or modified sequence from HRSV(A2)__F_DSCav1_mut1 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1882 - RNA, 2180 nt, synthetic construct
  misc_feature 1..2180: note = mRNA product Design f-4 comprising derived and/or modified sequence from HRSV(A2)__F_DSCav1_mut1 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1883 - RNA, 2180 nt, synthetic construct
  misc_feature 1..2180: note = mRNA product Design f-4 comprising derived and/or modified sequence from HRSV(A2)__F_DSCav1_mut1 (opt6)
  source 1..2180: mol_type = other RNA
gggagagtcccgcagtcggcgtccagcggctctgcttgttcgtgtgtgtgtcgttgcaggccttattcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1884 - RNA, 2180 nt, synthetic construct
  misc_feature 1..2180: note = mRNA product Design f-4 comprising derived and/or modified sequence from HRSV(A2)__F_DSCav1_mut1 (opt11)
  source 1..2180: mol_type = other RNA
gggagagtcccgcagtcggcgtccagcggctctgcttgttcgtgtgtgtgtcgttgcaggccttattcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1885 - RNA, 1956 nt, synthetic construct
  misc_feature 1..1956: note = mRNA product Design f-5 comprising derived and/or modified sequence from HRSV(A2)__F_DSCav1_mut1 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1886 - RNA, 1956 nt, synthetic construct
  misc_feature 1..1956: note = mRNA product Design f-5 comprising derived and/or modified sequence from HRSV(A2)__F_DSCav1_mut1 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1887 - RNA, 1956 nt, synthetic construct
  misc_feature 1..1956: note = mRNA product Design f-5 comprising derived and/or modified sequence from HRSV(A2)__F_DSCav1_mut1 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1888 - RNA, 1956 nt, synthetic construct
  misc_feature 1..1956: note = mRNA product Design f-5 comprising derived and/or modified sequence from HRSV(A2)__F_DSCav1_mut1 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1889 - RNA, 1956 nt, synthetic construct
  misc_feature 1..1956: note = mRNA product Design f-5 comprising derived and/or modified sequence from HRSV(A2)__F_DSCav1_mut1 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1890 - RNA, 1956 nt, synthetic construct
  misc_feature 1..1956: note = mRNA product Design f-5 comprising derived and/or modified sequence from HRSV(A2)__F_DSCav1_mut1 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1891 - RNA, 1956 nt, synthetic construct
  misc_feature 1..1956: note = mRNA product Design f-5 comprising derived and/or modified sequence from HRSV(A2)__F_DSCav1_mut1 (opt6)
  source 1..1956: mol_type = other RNA
gggagactttcccattctgtagcagaatttggtgttgcctgtggtcttggtcccgcggagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1892 - RNA, 1956 nt, synthetic construct
  misc_feature 1..1956: note = mRNA product Design f-5 comprising derived and/or modified sequence from HRSV(A2)__F_DSCav1_mut1 (opt11)
  source 1..1956: mol_type = other RNA
gggagactttcccattctgtagcagaatttggtgttgcctgtggtcttggtcccgcggagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1893 - RNA, 1952 nt, synthetic construct
  misc_feature 1..1952: note = mRNA product Design g-1 comprising derived and/or modified sequence from HRSV(A2)__F_DSCav1_mut1 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1894 - RNA, 1952 nt, synthetic construct
  misc_feature 1..1952: note = mRNA product Design g-1 comprising derived and/or modified sequence from HRSV(A2)__F_DSCav1_mut1 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1895 - RNA, 1952 nt, synthetic construct
  misc_feature 1..1952: note = mRNA product Design g-1 comprising derived and/or modified sequence from HRSV(A2)__F_DSCav1_mut1 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1896 - RNA, 1952 nt, synthetic construct
  misc_feature 1..1952: note = mRNA product Design g-1 comprising derived and/or modified sequence from HRSV(A2)__F_DSCav1_mut1 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1897 - RNA, 1952 nt, synthetic construct
  misc_feature 1..1952: note = mRNA product Design g-1 comprising derived and/or modified sequence from HRSV(A2)__F_DSCav1_mut1 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1898 - RNA, 1952 nt, synthetic construct
  misc_feature 1..1952: note = mRNA product Design g-1 comprising derived and/or modified sequence from HRSV(A2)__F_DSCav1_mut1 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1899 - RNA, 1952 nt, synthetic construct
  misc_feature 1..1952: note = mRNA product Design g-1 comprising derived and/or modified sequence from HRSV(A2)__F_DSCav1_mut1 (opt6)
  source 1..1952: mol_type = other RNA
gggagactttcccattctgtagcagaatttggtgttgcctgtggtcttggtcccgcggagaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1900 - RNA, 1952 nt, synthetic construct
  misc_feature 1..1952: note = mRNA product Design g-1 comprising derived and/or modified sequence from HRSV(A2)__F_DSCav1_mut1 (opt11)
  source 1..1952: mol_type = other RNA
gggagactttcccattctgtagcagaatttggtgttgcctgtggtcttggtcccgcggagaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1901 - RNA, 1967 nt, synthetic construct
  misc_feature 1..1967: note = mRNA product Design g-2 comprising derived and/or modified sequence from HRSV(A2)__F_DSCav1_mut1 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1902 - RNA, 1967 nt, synthetic construct
  misc_feature 1..1967: note = mRNA product Design g-2 comprising derived and/or modified sequence from HRSV(A2)__F_DSCav1_mut1 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1903 - RNA, 1967 nt, synthetic construct
  misc_feature 1..1967: note = mRNA product Design g-2 comprising derived and/or modified sequence from HRSV(A2)__F_DSCav1_mut1 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1904 - RNA, 1967 nt, synthetic construct
  misc_feature 1..1967: note = mRNA product Design g-2 comprising derived and/or modified sequence from HRSV(A2)__F_DSCav1_mut1 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1905 - RNA, 1967 nt, synthetic construct
  misc_feature 1..1967: note = mRNA product Design g-2 comprising derived and/or modified sequence from HRSV(A2)__F_DSCav1_mut1 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1906 - RNA, 1967 nt, synthetic construct
  misc_feature 1..1967: note = mRNA product Design g-2 comprising derived and/or modified sequence from HRSV(A2)__F_DSCav1_mut1 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1907 - RNA, 1967 nt, synthetic construct
  misc_feature 1..1967: note = mRNA product Design g-2 comprising derived and/or modified sequence from HRSV(A2)__F_DSCav1_mut1 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1908 - RNA, 1967 nt, synthetic construct
  misc_feature 1..1967: note = mRNA product Design g-2 comprising derived and/or modified sequence from HRSV(A2)__F_DSCav1_mut1 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1909 - RNA, 2199 nt, synthetic construct
  misc_feature 1..2199: note = mRNA product Design g-3 comprising derived and/or modified sequence from HRSV(A2)__F_DSCav1_mut1 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1910 - RNA, 2199 nt, synthetic construct
  misc_feature 1..2199: note = mRNA product Design g-3 comprising derived and/or modified sequence from HRSV(A2)__F_DSCav1_mut1 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1911 - RNA, 2199 nt, synthetic construct
  misc_feature 1..2199: note = mRNA product Design g-3 comprising derived and/or modified sequence from HRSV(A2)__F_DSCav1_mut1 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1912 - RNA, 2199 nt, synthetic construct
  misc_feature 1..2199: note = mRNA product Design g-3 comprising derived and/or modified sequence from HRSV(A2)__F_DSCav1_mut1 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1913 - RNA, 2199 nt, synthetic construct
  misc_feature 1..2199: note = mRNA product Design g-3 comprising derived and/or modified sequence from HRSV(A2)__F_DSCav1_mut1 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1914 - RNA, 2199 nt, synthetic construct
  misc_feature 1..2199: note = mRNA product Design g-3 comprising derived and/or modified sequence from HRSV(A2)__F_DSCav1_mut1 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1915 - RNA, 2199 nt, synthetic construct
  misc_feature 1..2199: note = mRNA product Design g-3 comprising derived and/or modified sequence from HRSV(A2)__F_DSCav1_mut1 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1916 - RNA, 2199 nt, synthetic construct
  misc_feature 1..2199: note = mRNA product Design g-3 comprising derived and/or modified sequence from HRSV(A2)__F_DSCav1_mut1 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1917 - RNA, 1994 nt, synthetic construct
  misc_feature 1..1994: note = mRNA product Design g-4 comprising derived and/or modified sequence from HRSV(A2)__F_DSCav1_mut1 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1918 - RNA, 1994 nt, synthetic construct
  misc_feature 1..1994: note = mRNA product Design g-4 comprising derived and/or modified sequence from HRSV(A2)__F_DSCav1_mut1 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1919 - RNA, 1994 nt, synthetic construct
  misc_feature 1..1994: note = mRNA product Design g-4 comprising derived and/or modified sequence from HRSV(A2)__F_DSCav1_mut1 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1920 - RNA, 1994 nt, synthetic construct
  misc_feature 1..1994: note = mRNA product Design g-4 comprising derived and/or modified sequence from HRSV(A2)__F_DSCav1_mut1 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1921 - RNA, 1994 nt, synthetic construct
  misc_feature 1..1994: note = mRNA product Design g-4 comprising derived and/or modified sequence from HRSV(A2)__F_DSCav1_mut1 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1922 - RNA, 1994 nt, synthetic construct
  misc_feature 1..1994: note = mRNA product Design g-4 comprising derived and/or modified sequence from HRSV(A2)__F_DSCav1_mut1 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1923 - RNA, 1994 nt, synthetic construct
  misc_feature 1..1994: note = mRNA product Design g-4 comprising derived and/or modified sequence from HRSV(A2)__F_DSCav1_mut1 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1924 - RNA, 1994 nt, synthetic construct
  misc_feature 1..1994: note = mRNA product Design g-4 comprising derived and/or modified sequence from HRSV(A2)__F_DSCav1_mut1 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1925 - RNA, 1970 nt, synthetic construct
  misc_feature 1..1970: note = mRNA product Design g-5 comprising derived and/or modified sequence from HRSV(A2)__F_DSCav1_mut1 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1926 - RNA, 1970 nt, synthetic construct
  misc_feature 1..1970: note = mRNA product Design g-5 comprising derived and/or modified sequence from HRSV(A2)__F_DSCav1_mut1 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1927 - RNA, 1970 nt, synthetic construct
  misc_feature 1..1970: note = mRNA product Design g-5 comprising derived and/or modified sequence from HRSV(A2)__F_DSCav1_mut1 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1928 - RNA, 1970 nt, synthetic construct
  misc_feature 1..1970: note = mRNA product Design g-5 comprising derived and/or modified sequence from HRSV(A2)__F_DSCav1_mut1 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1929 - RNA, 1970 nt, synthetic construct
  misc_feature 1..1970: note = mRNA product Design g-5 comprising derived and/or modified sequence from HRSV(A2)__F_DSCav1_mut1 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1930 - RNA, 1970 nt, synthetic construct
  misc_feature 1..1970: note = mRNA product Design g-5 comprising derived and/or modified sequence from HRSV(A2)__F_DSCav1_mut1 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1931 - RNA, 1970 nt, synthetic construct
  misc_feature 1..1970: note = mRNA product Design g-5 comprising derived and/or modified sequence from HRSV(A2)__F_DSCav1_mut1 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1932 - RNA, 1970 nt, synthetic construct
  misc_feature 1..1970: note = mRNA product Design g-5 comprising derived and/or modified sequence from HRSV(A2)__F_DSCav1_mut1 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1933 - RNA, 1986 nt, synthetic construct
  misc_feature 1..1986: note = mRNA product Design h-1 comprising derived and/or modified sequence from HRSV(A2)__F_DSCav1_mut1 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1934 - RNA, 1986 nt, synthetic construct
  misc_feature 1..1986: note = mRNA product Design h-1 comprising derived and/or modified sequence from HRSV(A2)__F_DSCav1_mut1 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1935 - RNA, 1986 nt, synthetic construct
  misc_feature 1..1986: note = mRNA product Design h-1 comprising derived and/or modified sequence from HRSV(A2)__F_DSCav1_mut1 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1936 - RNA, 1986 nt, synthetic construct
  misc_feature 1..1986: note = mRNA product Design h-1 comprising derived and/or modified sequence from HRSV(A2)__F_DSCav1_mut1 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1937 - RNA, 1986 nt, synthetic construct
  misc_feature 1..1986: note = mRNA product Design h-1 comprising derived and/or modified sequence from HRSV(A2)__F_DSCav1_mut1 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1938 - RNA, 1986 nt, synthetic construct
  misc_feature 1..1986: note = mRNA product Design h-1 comprising derived and/or modified sequence from HRSV(A2)__F_DSCav1_mut1 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1939 - RNA, 1986 nt, synthetic construct
  misc_feature 1..1986: note = mRNA product Design h-1 comprising derived and/or modified sequence from HRSV(A2)__F_DSCav1_mut1 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1940 - RNA, 1986 nt, synthetic construct
  misc_feature 1..1986: note = mRNA product Design h-1 comprising derived and/or modified sequence from HRSV(A2)__F_DSCav1_mut1 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1941 - RNA, 2202 nt, synthetic construct
  misc_feature 1..2202: note = mRNA product Design h-2 comprising derived and/or modified sequence from HRSV(A2)__F_DSCav1_mut1 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1942 - RNA, 2202 nt, synthetic construct
  misc_feature 1..2202: note = mRNA product Design h-2 comprising derived and/or modified sequence from HRSV(A2)__F_DSCav1_mut1 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1943 - RNA, 2202 nt, synthetic construct
  misc_feature 1..2202: note = mRNA product Design h-2 comprising derived and/or modified sequence from HRSV(A2)__F_DSCav1_mut1 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1944 - RNA, 2202 nt, synthetic construct
  misc_feature 1..2202: note = mRNA product Design h-2 comprising derived and/or modified sequence from HRSV(A2)__F_DSCav1_mut1 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1945 - RNA, 2202 nt, synthetic construct
  misc_feature 1..2202: note = mRNA product Design h-2 comprising derived and/or modified sequence from HRSV(A2)__F_DSCav1_mut1 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1946 - RNA, 2202 nt, synthetic construct
  misc_feature 1..2202: note = mRNA product Design h-2 comprising derived and/or modified sequence from HRSV(A2)__F_DSCav1_mut1 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1947 - RNA, 2202 nt, synthetic construct
  misc_feature 1..2202: note = mRNA product Design h-2 comprising derived and/or modified sequence from HRSV(A2)__F_DSCav1_mut1 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1948 - RNA, 2202 nt, synthetic construct
  misc_feature 1..2202: note = mRNA product Design h-2 comprising derived and/or modified sequence from HRSV(A2)__F_DSCav1_mut1 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1949 - RNA, 1982 nt, synthetic construct
  misc_feature 1..1982: note = mRNA product Design h-3 comprising derived and/or modified sequence from HRSV(A2)__F_DSCav1_mut1 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1950 - RNA, 1982 nt, synthetic construct
  misc_feature 1..1982: note = mRNA product Design h-3 comprising derived and/or modified sequence from HRSV(A2)__F_DSCav1_mut1 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1951 - RNA, 1982 nt, synthetic construct
  misc_feature 1..1982: note = mRNA product Design h-3 comprising derived and/or modified sequence from HRSV(A2)__F_DSCav1_mut1 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1952 - RNA, 1982 nt, synthetic construct
  misc_feature 1..1982: note = mRNA product Design h-3 comprising derived and/or modified sequence from HRSV(A2)__F_DSCav1_mut1 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1953 - RNA, 1982 nt, synthetic construct
  misc_feature 1..1982: note = mRNA product Design h-3 comprising derived and/or modified sequence from HRSV(A2)__F_DSCav1_mut1 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1954 - RNA, 1982 nt, synthetic construct
  misc_feature 1..1982: note = mRNA product Design h-3 comprising derived and/or modified sequence from HRSV(A2)__F_DSCav1_mut1 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1955 - RNA, 1982 nt, synthetic construct
  misc_feature 1..1982: note = mRNA product Design h-3 comprising derived and/or modified sequence from HRSV(A2)__F_DSCav1_mut1 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1956 - RNA, 1982 nt, synthetic construct
  misc_feature 1..1982: note = mRNA product Design h-3 comprising derived and/or modified sequence from HRSV(A2)__F_DSCav1_mut1 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1957 - RNA, 2045 nt, synthetic construct
  misc_feature 1..2045: note = mRNA product Design h-4 comprising derived and/or modified sequence from HRSV(A2)__F_DSCav1_mut1 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1958 - RNA, 2045 nt, synthetic construct
  misc_feature 1..2045: note = mRNA product Design h-4 comprising derived and/or modified sequence from HRSV(A2)__F_DSCav1_mut1 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1959 - RNA, 2045 nt, synthetic construct
  misc_feature 1..2045: note = mRNA product Design h-4 comprising derived and/or modified sequence from HRSV(A2)__F_DSCav1_mut1 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1960 - RNA, 2045 nt, synthetic construct
  misc_feature 1..2045: note = mRNA product Design h-4 comprising derived and/or modified sequence from HRSV(A2)__F_DSCav1_mut1 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1961 - RNA, 2045 nt, synthetic construct
  misc_feature 1..2045: note = mRNA product Design h-4 comprising derived and/or modified sequence from HRSV(A2)__F_DSCav1_mut1 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1962 - RNA, 2045 nt, synthetic construct
  misc_feature 1..2045: note = mRNA product Design h-4 comprising derived and/or modified sequence from HRSV(A2)__F_DSCav1_mut1 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1963 - RNA, 2045 nt, synthetic construct
  misc_feature 1..2045: note = mRNA product Design h-4 comprising derived and/or modified sequence from HRSV(A2)__F_DSCav1_mut1 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1964 - RNA, 2045 nt, synthetic construct
  misc_feature 1..2045: note = mRNA product Design h-4 comprising derived and/or modified sequence from HRSV(A2)__F_DSCav1_mut1 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1965 - RNA, 2061 nt, synthetic construct
  misc_feature 1..2061: note = mRNA product Design h-5 comprising derived and/or modified sequence from HRSV(A2)__F_DSCav1_mut1 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1966 - RNA, 2061 nt, synthetic construct
  misc_feature 1..2061: note = mRNA product Design h-5 comprising derived and/or modified sequence from HRSV(A2)__F_DSCav1_mut1 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1967 - RNA, 2061 nt, synthetic construct
  misc_feature 1..2061: note = mRNA product Design h-5 comprising derived and/or modified sequence from HRSV(A2)__F_DSCav1_mut1 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1968 - RNA, 2061 nt, synthetic construct
  misc_feature 1..2061: note = mRNA product Design h-5 comprising derived and/or modified sequence from HRSV(A2)__F_DSCav1_mut1 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1969 - RNA, 2061 nt, synthetic construct
  misc_feature 1..2061: note = mRNA product Design h-5 comprising derived and/or modified sequence from HRSV(A2)__F_DSCav1_mut1 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1970 - RNA, 2061 nt, synthetic construct
  misc_feature 1..2061: note = mRNA product Design h-5 comprising derived and/or modified sequence from HRSV(A2)__F_DSCav1_mut1 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1971 - RNA, 2061 nt, synthetic construct
  misc_feature 1..2061: note = mRNA product Design h-5 comprising derived and/or modified sequence from HRSV(A2)__F_DSCav1_mut1 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1972 - RNA, 2061 nt, synthetic construct
  misc_feature 1..2061: note = mRNA product Design h-5 comprising derived and/or modified sequence from HRSV(A2)__F_DSCav1_mut1 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1973 - RNA, 1994 nt, synthetic construct
  misc_feature 1..1994: note = mRNA product Design i-1 comprising derived and/or modified sequence from HRSV(A2)__F_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1974 - RNA, 1994 nt, synthetic construct
  misc_feature 1..1994: note = mRNA product Design i-1 comprising derived and/or modified sequence from HRSV(A2)__F_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1975 - RNA, 1994 nt, synthetic construct
  misc_feature 1..1994: note = mRNA product Design i-1 comprising derived and/or modified sequence from HRSV(A2)__F_DSCav1_mut1 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1976 - RNA, 1994 nt, synthetic construct
  misc_feature 1..1994: note = mRNA product Design i-1 comprising derived and/or modified sequence from HRSV(A2)__F_DSCav1_mut1 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1977 - RNA, 1994 nt, synthetic construct
  misc_feature 1..1994: note = mRNA product Design i-1 comprising derived and/or modified sequence from HRSV(A2)__F_DSCav1_mut1 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1978 - RNA, 1994 nt, synthetic construct
  misc_feature 1..1994: note = mRNA product Design i-1 comprising derived and/or modified sequence from HRSV(A2)__F_DSCav1_mut1 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1979 - RNA, 1994 nt, synthetic construct
  misc_feature 1..1994: note = mRNA product Design i-1 comprising derived and/or modified sequence from HRSV(A2)__F_DSCav1_mut1 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1980 - RNA, 1994 nt, synthetic construct
  misc_feature 1..1994: note = mRNA product Design i-1 comprising derived and/or modified sequence from HRSV(A2)__F_DSCav1_mut1 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1981 - RNA, 1994 nt, synthetic construct
  misc_feature 1..1994: note = mRNA product Design i-2 comprising derived and/or modified sequence from HRSV(A2)__F_DSCav1_mut1 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1982 - RNA, 1994 nt, synthetic construct
  misc_feature 1..1994: note = mRNA product Design i-2 comprising derived and/or modified sequence from HRSV(A2)__F_DSCav1_mut1 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1983 - RNA, 1994 nt, synthetic construct
  misc_feature 1..1994: note = mRNA product Design i-2 comprising derived and/or modified sequence from HRSV(A2)__F_DSCav1_mut1 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1984 - RNA, 1994 nt, synthetic construct
  misc_feature 1..1994: note = mRNA product Design i-2 comprising derived and/or modified sequence from HRSV(A2)__F_DSCav1_mut1 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1985 - RNA, 1994 nt, synthetic construct
  misc_feature 1..1994: note = mRNA product Design i-2 comprising derived and/or modified sequence from HRSV(A2)__F_DSCav1_mut1 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1986 - RNA, 1994 nt, synthetic construct
  misc_feature 1..1994: note = mRNA product Design i-2 comprising derived and/or modified sequence from HRSV(A2)__F_DSCav1_mut1 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1987 - RNA, 1994 nt, synthetic construct
  misc_feature 1..1994: note = mRNA product Design i-2 comprising derived and/or modified sequence from HRSV(A2)__F_DSCav1_mut1 (opt6)
  source 1..1994: mol_type = other RNA
gggagaggcgctgcctacggaggtggcagccatctccttctcggcatcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1988 - RNA, 1994 nt, synthetic construct
  misc_feature 1..1994: note = mRNA product Design i-2 comprising derived and/or modified sequence from HRSV(A2)__F_DSCav1_mut1 (opt11)
  source 1..1994: mol_type = other RNA
gggagaggcgctgcctacggaggtggcagccatctccttctcggcatcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1989 - RNA, 1990 nt, synthetic construct
  misc_feature 1..1990: note = mRNA product Design i-2 comprising derived and/or modified sequence from HRSV(A2)__F_DSCav1_mut1 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1990 - RNA, 1990 nt, synthetic construct
  misc_feature 1..1990: note = mRNA product Design i-2 comprising derived and/or modified sequence from HRSV(A2)__F_DSCav1_mut1 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1991 - RNA, 1990 nt, synthetic construct
  misc_feature 1..1990: note = mRNA product Design i-2 comprising derived and/or modified sequence from HRSV(A2)__F_DSCav1_mut1 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1992 - RNA, 1990 nt, synthetic construct
  misc_feature 1..1990: note = mRNA product Design i-2 comprising derived and/or modified sequence from HRSV(A2)__F_DSCav1_mut1 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1993 - RNA, 1990 nt, synthetic construct
  misc_feature 1..1990: note = mRNA product Design i-2 comprising derived and/or modified sequence from HRSV(A2)__F_DSCav1_mut1 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1994 - RNA, 1990 nt, synthetic construct
  misc_feature 1..1990: note = mRNA product Design i-2 comprising derived and/or modified sequence from HRSV(A2)__F_DSCav1_mut1 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1995 - RNA, 1990 nt, synthetic construct
  misc_feature 1..1990: note = mRNA product Design i-2 comprising derived and/or modified sequence from HRSV(A2)__F_DSCav1_mut1 (opt6)
  source 1..1990: mol_type = other RNA
ggggcgctgcctacggaggtggcagccatctccttctcggcatcaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1996 - RNA, 1990 nt, synthetic construct
  misc_feature 1..1990: note = mRNA product Design i-2 comprising derived and/or modified sequence from HRSV(A2)__F_DSCav1_mut1 (opt11)
  source 1..1990: mol_type = other RNA
ggggcgctgcctacggaggtggcagccatctccttctcggcatcaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1997 - RNA, 1825 nt, synthetic construct
  misc_feature 1..1825: note = mRNA product Design i-3 comprising derived and/or modified sequence from HRSV(A2)__F_DSCav1_mut1 (opt1) R6771
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1998 - RNA, 1825 nt, synthetic construct
  misc_feature 1..1825: note = mRNA product Design i-3 comprising derived and/or modified sequence from HRSV(A2)__F_DSCav1_mut1 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 1999 - RNA, 1825 nt, synthetic construct
  misc_feature 1..1825: note = mRNA product Design i-3 comprising derived and/or modified sequence from HRSV(A2)__F_DSCav1_mut1 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2000 - RNA, 1825 nt, synthetic construct
  misc_feature 1..1825: note = mRNA product Design i-3 comprising derived and/or modified sequence from HRSV(A2)__F_DSCav1_mut1 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagaccaactctctgggataaacaatatcgcattcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2001 - RNA, 1825 nt, synthetic construct
  misc_feature 1..1825: note = mRNA product Design i-3 comprising derived and/or modified sequence from HRSV(A2)__F_DSCav1_mut1 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2002 - RNA, 1825 nt, synthetic construct
  misc_feature 1..1825: note = mRNA product Design i-3 comprising derived and/or modified sequence from HRSV(A2)__F_DSCav1_mut1 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagaccaactctccggaattaacaatatcgctttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2003 - RNA, 1825 nt, synthetic construct
  misc_feature 1..1825: note = mRNA product Design i-3 comprising derived and/or modified sequence from HRSV(A2)__F_DSCav1_mut1 (opt6)
  source 1..1825: mol_type = other RNA
gggagaaagcttaccatggaactattaatactaaaagcaaacgctataacaacaatactaacagcagtcacattctgctttgcatcaggccaaaacatcacagaagaattttaccaatcaacatgctccgccgtatcgaaaggatacctaggcgcattaagaaccggatggtatacatcagtcataacaattgaactatctaacataaaagaaaacaaatgtaacggcacagatgccaaagtaaaactcatcaaacaagaattagataaatacaaaaacgcagtcactgaactacaactcttaatgcaatcaacacctgcaacaggatcaggatcagcaatatgctcaggagtagccgtatgtaaagtactacacctagaaggagaagtcaacaaaataaaatcagccctcctaagtacaaacaaagctgtcgtatcactatccaatggtgtttcagtactaactttcaaagttctagacctaaaaaactacatagacaaacaactactaccaatactaaataaacaaagttgttctatacccaacatagaaaccgtcatagaatttcaacaaaaaaataatagactcctagaaataacaagagaattttcagttaacgcaggtgtaacaaccccagtatccacctatatgctaacaaattcagaattactttccctaatcaacgacatgcccataacaaatgaccaaaaaaaattaatgtcaaacaacgtccaaatagttcgtcaacaatcatattcaataatgtgcataataaaagaagaagtcttagcctacgtagtacaacttcccctttatggagttatcgacacaccctgctggaaactccacacttcaccactatgtactacaaacacaaaagaaggatccaacatctgcctcacaagaaccgatcgaggatggtactgtgataacgccggatccgtctcattcttcccacaagcagaaacatgcaaagtacaatcaaacagagtattttgcgacacaatgaactccctcacattaccttctgaagtaaacctatgtaatgtagacatattcaaccccaaatacgattgcaaaataatgacatcaaagacagatgtatcatcaagtgtcatcacatccctaggagcaattgtctcatgttatggtaaaacaaaatgcaccgcatcaaataaaaacagaggcataataaaaaccttctcaaacggttgtgactacgtatccaataaaggcgtcgacacagtatcagtaggtaacacattatattgtgtaaacaaacaagaaggacagtccctatatgtaaaaggagaaccaataatcaacttctacgacccacttgttttcccttctgatgaatttgacgcaagtatatcacaagtaaatgaaaaaatcaatcaatcactagcctttataagaaaatcagatgaattattacacaacgtaaacgccggaaaatcaacaaccaacataatgataaccacaataataatcgtcataatagtcatcctactatcactcatagcagttggactcctactatactgcaaagcacgatcaacaccagtaacattatccaaagaccaactaagtggtatcaataacatcgccttttcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2004 - RNA, 1825 nt, synthetic construct
  misc_feature 1..1825: note = mRNA product Design i-3 comprising derived and/or modified sequence from HRSV(A2)__F_DSCav1_mut1 (opt11)
  source 1..1825: mol_type = other RNA
gggagaaagcttaccatggaactcctaatcctcaaagccaacgcaatcaccacaatcctcactgccgtcaccttctgcttcgcctccggccaaaacataacagaagaattttaccaatcaacctgttcagcggtctccaaaggctacctcggcgccctccgcaccggctggtacacctccgtgatcaccatagaactctccaacatcaaggaaaacaaatgcaacggcaccgacgcgaaggtcaaacttattaaacaagaactcgacaaatacaaaaacgcagtcaccgaactacaactcctaatgcagtccacgccagccaccggctctggctcagccatatgctccggtgtggccgtatgcaaagtcctacacctcgaaggagaagtcaacaaaataaaatccgccctactgtccacaaacaaggccgtagtctccctctcaaacggcgtctcagtactcaccttcaaagtcctagacctcaagaactacatcgacaaacaactcctacccatactaaacaaacaatcctgctcaatccccaacatcgaaaccgtaatagaatttcaacaaaaaaacaacagactcctggagatcacccgggaattttccgtaaacgccggagtcacaacacccgtctcaacctacatgctaacgaactcagagctcctctcacttatcaacgacatgcccataacaaacgaccaaaaaaaactcatgtccaacaacgtgcaaatcgtccgacaacaatcctactccatcatgtgcatcattaaagaagaagtcctcgcatacgtagtccagctccccctctacggcgtcatagacaccccctgctggaaactacacacatcacccctctgcacaacaaacaccaaagaaggctccaacatctgcctcacccgcaccgaccgaggctggtactgcgataacgccggcagcgtctccttcttcccccaagcagaaacctgcaaggtccaatccaaccgagttttctgcgacactatgaactcgctcaccctcccctccgaagtcaacctctgcaacgtcgacattttcaaccccaaatacgactgcaaaatcatgacctccaagaccgacgtatcctcctccgtcatcacctccctaggcgccatagtaagttgctacggcaaaaccaagtgcacagcaagcaacaaaaaccgaggaataatcaaaaccttctccaacggctgcgactacgtatccaacaagggcgtcgacaccgtatccgtagggaacaccctttactgcgtaaacaaacaagaaggacaatcactctacgtaaaaggcgaacccataatcaacttctacgaccccctcgtatttccctccgacgaatttgacgcatcaatctcacaggtcaacgaaaaaataaaccaatcgctagcattcatcagaaaatcagacgaactcctacacaacgtcaacgcaggcaagagcaccaccaacatcatgatcaccaccatcatcatcgtcataatcgtcatactactctcactcatagcagtcggcctcctcctatactgtaaagcaaggtcgaccccagtcaccctatccaaagaccaactaagcggcatcaacaacatcgcgttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2005 - protein, 514 aa, synthetic construct
  REGION 1..514: note = derived and/or modified protein sequence (artificial) from HRSV(A2)__F-del_DSCav1_mut1
MELLILKANAITTILTAVTFCFASGQNITEEFYQSTCSAVSKGYLGALRTGWYTSVITIELSNIKENKCNGTDAKVKLIKQELDKYKNAVTELQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 2006 - RNA, 1545 nt, synthetic construct
  misc_feature 1..1545: note = derived and/or modified CDS sequence (opt1) from HRSV(A2)__F-del_DSCav1_mut1
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 2007 - RNA, 1545 nt, synthetic construct
  misc_feature 1..1545: note = derived and/or modified CDS sequence (opt1) from HRSV(A2)__F-del_DSCav1_mut1
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtga

SEQ ID NO: 2008 - RNA, 1545 nt, synthetic construct
  misc_feature 1..1545: note = derived and/or modified CDS sequence (opt2) from HRSV(A2)__F-del_DSCav1_mut1
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 2009 - RNA, 1545 nt, synthetic construct
  misc_feature 1..1545: note = derived and/or modified CDS sequence (opt3) from HRSV(A2)__F-del_DSCav1_mut1
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctga

SEQ ID NO: 2010 - RNA, 1545 nt, synthetic construct
  misc_feature 1..1545: note = derived and/or modified CDS sequence (opt4) from HRSV(A2)__F-del_DSCav1_mut1
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 2011 - RNA, 1545 nt, synthetic construct
  misc_feature 1..1545: note = derived and/or modified CDS sequence (opt5) from HRSV(A2)__F-del_DSCav1_mut1
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatga

SEQ ID NO: 2012 - RNA, 1545 nt, synthetic construct
  misc_feature 1..1545: note = derived and/or modified CDS sequence (opt6) from HRSV(A2)__F-del_DSCav1_mut1
  source 1..1545: mol_type = other RNA
atggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataa

SEQ ID NO: 2013 - RNA, 1545 nt, synthetic construct
  misc_feature 1..1545: note = derived and/or modified CDS sequence (opt11) from HRSV(A2)__F-del_DSCav1_mut1
  source 1..1545: mol_type = other RNA
atggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaa

SEQ ID NO: 2014 - RNA, 1821 nt, synthetic construct
  misc_feature 1..1821: note = mRNA product Design a-1 comprising derived and/or modified sequence from HRSV(A2)__F-del_DSCav1_mut1 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2015 - RNA, 1821 nt, synthetic construct
  misc_feature 1..1821: note = mRNA product Design a-1 comprising derived and/or modified sequence from HRSV(A2)__F-del_DSCav1_mut1 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2016 - RNA, 1821 nt, synthetic construct
  misc_feature 1..1821: note = mRNA product Design a-1 comprising derived and/or modified sequence from HRSV(A2)__F-del_DSCav1_mut1 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2017 - RNA, 1821 nt, synthetic construct
  misc_feature 1..1821: note = mRNA product Design a-1 comprising derived and/or modified sequence from HRSV(A2)__F-del_DSCav1_mut1 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2018 - RNA, 1821 nt, synthetic construct
  misc_feature 1..1821: note = mRNA product Design a-1 comprising derived and/or modified sequence from HRSV(A2)__F-del_DSCav1_mut1 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2019 - RNA, 1821 nt, synthetic construct
  misc_feature 1..1821: note = mRNA product Design a-1 comprising derived and/or modified sequence from HRSV(A2)__F-del_DSCav1_mut1 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2020 - RNA, 1821 nt, synthetic construct
  misc_feature 1..1821: note = mRNA product Design a-1 comprising derived and/or modified sequence from HRSV(A2)__F-del_DSCav1_mut1 (opt6)
  source 1..1821: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2021 - RNA, 1821 nt, synthetic construct
  misc_feature 1..1821: note = mRNA product Design a-1 comprising derived and/or modified sequence from HRSV(A2)__F-del_DSCav1_mut1 (opt11)
  source 1..1821: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2022 - RNA, 1840 nt, synthetic construct
  misc_feature 1..1840: note = mRNA product Design a-2 comprising derived and/or modified sequence from HRSV(A2)__F-del_DSCav1_mut1 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2023 - RNA, 1840 nt, synthetic construct
  misc_feature 1..1840: note = mRNA product Design a-2 comprising derived and/or modified sequence from HRSV(A2)__F-del_DSCav1_mut1 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2024 - RNA, 1840 nt, synthetic construct
  misc_feature 1..1840: note = mRNA product Design a-2 comprising derived and/or modified sequence from HRSV(A2)__F-del_DSCav1_mut1 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2025 - RNA, 1840 nt, synthetic construct
  misc_feature 1..1840: note = mRNA product Design a-2 comprising derived and/or modified sequence from HRSV(A2)__F-del_DSCav1_mut1 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2026 - RNA, 1840 nt, synthetic construct
  misc_feature 1..1840: note = mRNA product Design a-2 comprising derived and/or modified sequence from HRSV(A2)__F-del_DSCav1_mut1 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2027 - RNA, 1840 nt, synthetic construct
  misc_feature 1..1840: note = mRNA product Design a-2 comprising derived and/or modified sequence from HRSV(A2)__F-del_DSCav1_mut1 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2028 - RNA, 1840 nt, synthetic construct
  misc_feature 1..1840: note = mRNA product Design a-2 comprising derived and/or modified sequence from HRSV(A2)__F-del_DSCav1_mut1 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2029 - RNA, 1840 nt, synthetic construct
  misc_feature 1..1840: note = mRNA product Design a-2 comprising derived and/or modified sequence from HRSV(A2)__F-del_DSCav1_mut1 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2030 - RNA, 1918 nt, synthetic construct
  misc_feature 1..1918: note = mRNA product Design a-3 comprising derived and/or modified sequence from HRSV(A2)__F-del_DSCav1_mut1 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2031 - RNA, 1918 nt, synthetic construct
  misc_feature 1..1918: note = mRNA product Design a-3 comprising derived and/or modified sequence from HRSV(A2)__F-del_DSCav1_mut1 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2032 - RNA, 1918 nt, synthetic construct
  misc_feature 1..1918: note = mRNA product Design a-3 comprising derived and/or modified sequence from HRSV(A2)__F-del_DSCav1_mut1 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2033 - RNA, 1918 nt, synthetic construct
  misc_feature 1..1918: note = mRNA product Design a-3 comprising derived and/or modified sequence from HRSV(A2)__F-del_DSCav1_mut1 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2034 - RNA, 1918 nt, synthetic construct
  misc_feature 1..1918: note = mRNA product Design a-3 comprising derived and/or modified sequence from HRSV(A2)__F-del_DSCav1_mut1 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2035 - RNA, 1918 nt, synthetic construct
  misc_feature 1..1918: note = mRNA product Design a-3 comprising derived and/or modified sequence from HRSV(A2)__F-del_DSCav1_mut1 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2036 - RNA, 1918 nt, synthetic construct
  misc_feature 1..1918: note = mRNA product Design a-3 comprising derived and/or modified sequence from HRSV(A2)__F-del_DSCav1_mut1 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2037 - RNA, 1918 nt, synthetic construct
  misc_feature 1..1918: note = mRNA product Design a-3 comprising derived and/or modified sequence from HRSV(A2)__F-del_DSCav1_mut1 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2038 - RNA, 1867 nt, synthetic construct
  misc_feature 1..1867: note = mRNA product Design a-4 comprising derived and/or modified sequence from HRSV(A2)__F-del_DSCav1_mut1 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2039 - RNA, 1867 nt, synthetic construct
  misc_feature 1..1867: note = mRNA product Design a-4 comprising derived and/or modified sequence from HRSV(A2)__F-del_DSCav1_mut1 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2040 - RNA, 1867 nt, synthetic construct
  misc_feature 1..1867: note = mRNA product Design a-4 comprising derived and/or modified sequence from HRSV(A2)__F-del_DSCav1_mut1 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2041 - RNA, 1867 nt, synthetic construct
  misc_feature 1..1867: note = mRNA product Design a-4 comprising derived and/or modified sequence from HRSV(A2)__F-del_DSCav1_mut1 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2042 - RNA, 1867 nt, synthetic construct
  misc_feature 1..1867: note = mRNA product Design a-4 comprising derived and/or modified sequence from HRSV(A2)__F-del_DSCav1_mut1 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2043 - RNA, 1867 nt, synthetic construct
  misc_feature 1..1867: note = mRNA product Design a-4 comprising derived and/or modified sequence from HRSV(A2)__F-del_DSCav1_mut1 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2044 - RNA, 1867 nt, synthetic construct
  misc_feature 1..1867: note = mRNA product Design a-4 comprising derived and/or modified sequence from HRSV(A2)__F-del_DSCav1_mut1 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2045 - RNA, 1867 nt, synthetic construct
  misc_feature 1..1867: note = mRNA product Design a-4 comprising derived and/or modified sequence from HRSV(A2)__F-del_DSCav1_mut1 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2046 - RNA, 1813 nt, synthetic construct
  misc_feature 1..1813: note = mRNA product Design a-5 comprising derived and/or modified sequence from HRSV(A2)__F-del_DSCav1_mut1 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2047 - RNA, 1813 nt, synthetic construct
  misc_feature 1..1813: note = mRNA product Design a-5 comprising derived and/or modified sequence from HRSV(A2)__F-del_DSCav1_mut1 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2048 - RNA, 1813 nt, synthetic construct
  misc_feature 1..1813: note = mRNA product Design a-5 comprising derived and/or modified sequence from HRSV(A2)__F-del_DSCav1_mut1 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2049 - RNA, 1813 nt, synthetic construct
  misc_feature 1..1813: note = mRNA product Design a-5 comprising derived and/or modified sequence from HRSV(A2)__F-del_DSCav1_mut1 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2050 - RNA, 1813 nt, synthetic construct
  misc_feature 1..1813: note = mRNA product Design a-5 comprising derived and/or modified sequence from HRSV(A2)__F-del_DSCav1_mut1 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2051 - RNA, 1813 nt, synthetic construct
  misc_feature 1..1813: note = mRNA product Design a-5 comprising derived and/or modified sequence from HRSV(A2)__F-del_DSCav1_mut1 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2052 - RNA, 1813 nt, synthetic construct
  misc_feature 1..1813: note = mRNA product Design a-5 comprising derived and/or modified sequence from HRSV(A2)__F-del_DSCav1_mut1 (opt6)
  source 1..1813: mol_type = other RNA
gggagactttcccattctgtagcagaatttggtgttgcctgtggtcttggtcccgcggagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2053 - RNA, 1813 nt, synthetic construct
  misc_feature 1..1813: note = mRNA product Design a-5 comprising derived and/or modified sequence from HRSV(A2)__F-del_DSCav1_mut1 (opt11)
  source 1..1813: mol_type = other RNA
gggagactttcccattctgtagcagaatttggtgttgcctgtggtcttggtcccgcggagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2054 - RNA, 1994 nt, synthetic construct
  misc_feature 1..1994: note = mRNA product Design b-1 comprising derived and/or modified sequence from HRSV(A2)__F-del_DSCav1_mut1 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2055 - RNA, 1994 nt, synthetic construct
  misc_feature 1..1994: note = mRNA product Design b-1 comprising derived and/or modified sequence from HRSV(A2)__F-del_DSCav1_mut1 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2056 - RNA, 1994 nt, synthetic construct
  misc_feature 1..1994: note = mRNA product Design b-1 comprising derived and/or modified sequence from HRSV(A2)__F-del_DSCav1_mut1 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2057 - RNA, 1994 nt, synthetic construct
  misc_feature 1..1994: note = mRNA product Design b-1 comprising derived and/or modified sequence from HRSV(A2)__F-del_DSCav1_mut1 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2058 - RNA, 1994 nt, synthetic construct
  misc_feature 1..1994: note = mRNA product Design b-1 comprising derived and/or modified sequence from HRSV(A2)__F-del_DSCav1_mut1 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2059 - RNA, 1994 nt, synthetic construct
  misc_feature 1..1994: note = mRNA product Design b-1 comprising derived and/or modified sequence from HRSV(A2)__F-del_DSCav1_mut1 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2060 - RNA, 1994 nt, synthetic construct
  misc_feature 1..1994: note = mRNA product Design b-1 comprising derived and/or modified sequence from HRSV(A2)__F-del_DSCav1_mut1 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2061 - RNA, 1994 nt, synthetic construct
  misc_feature 1..1994: note = mRNA product Design b-1 comprising derived and/or modified sequence from HRSV(A2)__F-del_DSCav1_mut1 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2062 - RNA, 1814 nt, synthetic construct
  misc_feature 1..1814: note = mRNA product Design b-2 comprising derived and/or modified sequence from HRSV(A2)__F-del_DSCav1_mut1 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2063 - RNA, 1814 nt, synthetic construct
  misc_feature 1..1814: note = mRNA product Design b-2 comprising derived and/or modified sequence from HRSV(A2)__F-del_DSCav1_mut1 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2064 - RNA, 1814 nt, synthetic construct
  misc_feature 1..1814: note = mRNA product Design b-2 comprising derived and/or modified sequence from HRSV(A2)__F-del_DSCav1_mut1 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2065 - RNA, 1814 nt, synthetic construct
  misc_feature 1..1814: note = mRNA product Design b-2 comprising derived and/or modified sequence from HRSV(A2)__F-del_DSCav1_mut1 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2066 - RNA, 1814 nt, synthetic construct
  misc_feature 1..1814: note = mRNA product Design b-2 comprising derived and/or modified sequence from HRSV(A2)__F-del_DSCav1_mut1 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2067 - RNA, 1814 nt, synthetic construct
  misc_feature 1..1814: note = mRNA product Design b-2 comprising derived and/or modified sequence from HRSV(A2)__F-del_DSCav1_mut1 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2068 - RNA, 1814 nt, synthetic construct
  misc_feature 1..1814: note = mRNA product Design b-2 comprising derived and/or modified sequence from HRSV(A2)__F-del_DSCav1_mut1 (opt6)
  source 1..1814: mol_type = other RNA
gggagagcctctgctggagtccggggagtggcgttggctgctagagcgaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2069 - RNA, 1814 nt, synthetic construct
  misc_feature 1..1814: note = mRNA product Design b-2 comprising derived and/or modified sequence from HRSV(A2)__F-del_DSCav1_mut1 (opt11)
  source 1..1814: mol_type = other RNA
gggagagcctctgctggagtccggggagtggcgttggctgctagagcgaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2070 - RNA, 1834 nt, synthetic construct
  misc_feature 1..1834: note = mRNA product Design b-3 comprising derived and/or modified sequence from HRSV(A2)__F-del_DSCav1_mut1 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2071 - RNA, 1834 nt, synthetic construct
  misc_feature 1..1834: note = mRNA product Design b-3 comprising derived and/or modified sequence from HRSV(A2)__F-del_DSCav1_mut1 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2072 - RNA, 1834 nt, synthetic construct
  misc_feature 1..1834: note = mRNA product Design b-3 comprising derived and/or modified sequence from HRSV(A2)__F-del_DSCav1_mut1 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2073 - RNA, 1834 nt, synthetic construct
  misc_feature 1..1834: note = mRNA product Design b-3 comprising derived and/or modified sequence from HRSV(A2)__F-del_DSCav1_mut1 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2074 - RNA, 1834 nt, synthetic construct
  misc_feature 1..1834: note = mRNA product Design b-3 comprising derived and/or modified sequence from HRSV(A2)__F-del_DSCav1_mut1 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2075 - RNA, 1834 nt, synthetic construct
  misc_feature 1..1834: note = mRNA product Design b-3 comprising derived and/or modified sequence from HRSV(A2)__F-del_DSCav1_mut1 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2076 - RNA, 1834 nt, synthetic construct
  misc_feature 1..1834: note = mRNA product Design b-3 comprising derived and/or modified sequence from HRSV(A2)__F-del_DSCav1_mut1 (opt6)
  source 1..1834: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2077 - RNA, 1834 nt, synthetic construct
  misc_feature 1..1834: note = mRNA product Design b-3 comprising derived and/or modified sequence from HRSV(A2)__F-del_DSCav1_mut1 (opt11)
  source 1..1834: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2078 - RNA, 1885 nt, synthetic construct
  misc_feature 1..1885: note = mRNA product Design b-4 comprising derived and/or modified sequence from HRSV(A2)__F-del_DSCav1_mut1 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2079 - RNA, 1885 nt, synthetic construct
  misc_feature 1..1885: note = mRNA product Design b-4 comprising derived and/or modified sequence from HRSV(A2)__F-del_DSCav1_mut1 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2080 - RNA, 1885 nt, synthetic construct
  misc_feature 1..1885: note = mRNA product Design b-4 comprising derived and/or modified sequence from HRSV(A2)__F-del_DSCav1_mut1 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2081 - RNA, 1885 nt, synthetic construct
  misc_feature 1..1885: note = mRNA product Design b-4 comprising derived and/or modified sequence from HRSV(A2)__F-del_DSCav1_mut1 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2082 - RNA, 1885 nt, synthetic construct
  misc_feature 1..1885: note = mRNA product Design b-4 comprising derived and/or modified sequence from HRSV(A2)__F-del_DSCav1_mut1 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2083 - RNA, 1885 nt, synthetic construct
  misc_feature 1..1885: note = mRNA product Design b-4 comprising derived and/or modified sequence from HRSV(A2)__F-del_DSCav1_mut1 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2084 - RNA, 1885 nt, synthetic construct
  misc_feature 1..1885: note = mRNA product Design b-4 comprising derived and/or modified sequence from HRSV(A2)__F-del_DSCav1_mut1 (opt6)
  source 1..1885: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2085 - RNA, 1885 nt, synthetic construct
  misc_feature 1..1885: note = mRNA product Design b-4 comprising derived and/or modified sequence from HRSV(A2)__F-del_DSCav1_mut1 (opt11)
  source 1..1885: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2086 - RNA, 1947 nt, synthetic construct
  misc_feature 1..1947: note = mRNA product Design b-5 comprising derived and/or modified sequence from HRSV(A2)__F-del_DSCav1_mut1 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2087 - RNA, 1947 nt, synthetic construct
  misc_feature 1..1947: note = mRNA product Design b-5 comprising derived and/or modified sequence from HRSV(A2)__F-del_DSCav1_mut1 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2088 - RNA, 1947 nt, synthetic construct
  misc_feature 1..1947: note = mRNA product Design b-5 comprising derived and/or modified sequence from HRSV(A2)__F-del_DSCav1_mut1 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2089 - RNA, 1947 nt, synthetic construct
  misc_feature 1..1947: note = mRNA product Design b-5 comprising derived and/or modified sequence from HRSV(A2)__F-del_DSCav1_mut1 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2090 - RNA, 1947 nt, synthetic construct
  misc_feature 1..1947: note = mRNA product Design b-5 comprising derived and/or modified sequence from HRSV(A2)__F-del_DSCav1_mut1 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2091 - RNA, 1947 nt, synthetic construct
  misc_feature 1..1947: note = mRNA product Design b-5 comprising derived and/or modified sequence from HRSV(A2)__F-del_DSCav1_mut1 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2092 - RNA, 1947 nt, synthetic construct
  misc_feature 1..1947: note = mRNA product Design b-5 comprising derived and/or modified sequence from HRSV(A2)__F-del_DSCav1_mut1 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2093 - RNA, 1947 nt, synthetic construct
  misc_feature 1..1947: note = mRNA product Design b-5 comprising derived and/or modified sequence from HRSV(A2)__F-del_DSCav1_mut1 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2094 - RNA, 1853 nt, synthetic construct
  misc_feature 1..1853: note = mRNA product Design c-1 comprising derived and/or modified sequence from HRSV(A2)__F-del_DSCav1_mut1 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2095 - RNA, 1853 nt, synthetic construct
  misc_feature 1..1853: note = mRNA product Design c-1 comprising derived and/or modified sequence from HRSV(A2)__F-del_DSCav1_mut1 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2096 - RNA, 1853 nt, synthetic construct
  misc_feature 1..1853: note = mRNA product Design c-1 comprising derived and/or modified sequence from HRSV(A2)__F-del_DSCav1_mut1 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2097 - RNA, 1853 nt, synthetic construct
  misc_feature 1..1853: note = mRNA product Design c-1 comprising derived and/or modified sequence from HRSV(A2)__F-del_DSCav1_mut1 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2098 - RNA, 1853 nt, synthetic construct
  misc_feature 1..1853: note = mRNA product Design c-1 comprising derived and/or modified sequence from HRSV(A2)__F-del_DSCav1_mut1 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2099 - RNA, 1853 nt, synthetic construct
  misc_feature 1..1853: note = mRNA product Design c-1 comprising derived and/or modified sequence from HRSV(A2)__F-del_DSCav1_mut1 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2100 - RNA, 1853 nt, synthetic construct
  misc_feature 1..1853: note = mRNA product Design c-1 comprising derived and/or modified sequence from HRSV(A2)__F-del_DSCav1_mut1 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2101 - RNA, 1853 nt, synthetic construct
  misc_feature 1..1853: note = mRNA product Design c-1 comprising derived and/or modified sequence from HRSV(A2)__F-del_DSCav1_mut1 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2102 - RNA, 1943 nt, synthetic construct
  misc_feature 1..1943: note = mRNA product Design c-2 comprising derived and/or modified sequence from HRSV(A2)__F-del_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2103 - RNA, 1943 nt, synthetic construct
  misc_feature 1..1943: note = mRNA product Design c-2 comprising derived and/or modified sequence from HRSV(A2)__F-del_DSCav1_mut1 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2104 - RNA, 1943 nt, synthetic construct
  misc_feature 1..1943: note = mRNA product Design c-2 comprising derived and/or modified sequence from HRSV(A2)__F-del_DSCav1_mut1 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2105 - RNA, 1943 nt, synthetic construct
  misc_feature 1..1943: note = mRNA product Design c-2 comprising derived and/or modified sequence from HRSV(A2)__F-del_DSCav1_mut1 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2106 - RNA, 1943 nt, synthetic construct
  misc_feature 1..1943: note = mRNA product Design c-2 comprising derived and/or modified sequence from HRSV(A2)__F-del_DSCav1_mut1 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2107 - RNA, 1943 nt, synthetic construct
  misc_feature 1..1943: note = mRNA product Design c-2 comprising derived and/or modified sequence from HRSV(A2)__F-del_DSCav1_mut1 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2108 - RNA, 1943 nt, synthetic construct
  misc_feature 1..1943: note = mRNA product Design c-2 comprising derived and/or modified sequence from HRSV(A2)__F-del_DSCav1_mut1 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2109 - RNA, 1943 nt, synthetic construct
  misc_feature 1..1943: note = mRNA product Design c-2 comprising derived and/or modified sequence from HRSV(A2)__F-del_DSCav1_mut1 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2110 - RNA, 1920 nt, synthetic construct
  misc_feature 1..1920: note = mRNA product Design c-3 comprising derived and/or modified sequence from HRSV(A2)__F-del_DSCav1_mut1 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2111 - RNA, 1920 nt, synthetic construct
  misc_feature 1..1920: note = mRNA product Design c-3 comprising derived and/or modified sequence from HRSV(A2)__F-del_DSCav1_mut1 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2112 - RNA, 1920 nt, synthetic construct
  misc_feature 1..1920: note = mRNA product Design c-3 comprising derived and/or modified sequence from HRSV(A2)__F-del_DSCav1_mut1 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2113 - RNA, 1920 nt, synthetic construct
  misc_feature 1..1920: note = mRNA product Design c-3 comprising derived and/or modified sequence from HRSV(A2)__F-del_DSCav1_mut1 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2114 - RNA, 1920 nt, synthetic construct
  misc_feature 1..1920: note = mRNA product Design c-3 comprising derived and/or modified sequence from HRSV(A2)__F-del_DSCav1_mut1 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2115 - RNA, 1920 nt, synthetic construct
  misc_feature 1..1920: note = mRNA product Design c-3 comprising derived and/or modified sequence from HRSV(A2)__F-del_DSCav1_mut1 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2116 - RNA, 1920 nt, synthetic construct
  misc_feature 1..1920: note = mRNA product Design c-3 comprising derived and/or modified sequence from HRSV(A2)__F-del_DSCav1_mut1 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2117 - RNA, 1920 nt, synthetic construct
  misc_feature 1..1920: note = mRNA product Design c-3 comprising derived and/or modified sequence from HRSV(A2)__F-del_DSCav1_mut1 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2118 - RNA, 1916 nt, synthetic construct
  misc_feature 1..1916: note = mRNA product Design c-4 comprising derived and/or modified sequence from HRSV(A2)__F-del_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2119 - RNA, 1916 nt, synthetic construct
  misc_feature 1..1916: note = mRNA product Design c-4 comprising derived and/or modified sequence from HRSV(A2)__F-del_DSCav1_mut1 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2120 - RNA, 1916 nt, synthetic construct
  misc_feature 1..1916: note = mRNA product Design c-4 comprising derived and/or modified sequence from HRSV(A2)__F-del_DSCav1_mut1 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2121 - RNA, 1916 nt, synthetic construct
  misc_feature 1..1916: note = mRNA product Design c-4 comprising derived and/or modified sequence from HRSV(A2)__F-del_DSCav1_mut1 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2122 - RNA, 1916 nt, synthetic construct
  misc_feature 1..1916: note = mRNA product Design c-4 comprising derived and/or modified sequence from HRSV(A2)__F-del_DSCav1_mut1 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2123 - RNA, 1916 nt, synthetic construct
  misc_feature 1..1916: note = mRNA product Design c-4 comprising derived and/or modified sequence from HRSV(A2)__F-del_DSCav1_mut1 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2124 - RNA, 1916 nt, synthetic construct
  misc_feature 1..1916: note = mRNA product Design c-4 comprising derived and/or modified sequence from HRSV(A2)__F-del_DSCav1_mut1 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2125 - RNA, 1916 nt, synthetic construct
  misc_feature 1..1916: note = mRNA product Design c-4 comprising derived and/or modified sequence from HRSV(A2)__F-del_DSCav1_mut1 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2126 - RNA, 1834 nt, synthetic construct
  misc_feature 1..1834: note = mRNA product Design c-5 comprising derived and/or modified sequence from HRSV(A2)__F-del_DSCav1_mut1 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2127 - RNA, 1834 nt, synthetic construct
  misc_feature 1..1834: note = mRNA product Design c-5 comprising derived and/or modified sequence from HRSV(A2)__F-del_DSCav1_mut1 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2128 - RNA, 1834 nt, synthetic construct
  misc_feature 1..1834: note = mRNA product Design c-5 comprising derived and/or modified sequence from HRSV(A2)__F-del_DSCav1_mut1 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2129 - RNA, 1834 nt, synthetic construct
  misc_feature 1..1834: note = mRNA product Design c-5 comprising derived and/or modified sequence from HRSV(A2)__F-del_DSCav1_mut1 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2130 - RNA, 1834 nt, synthetic construct
  misc_feature 1..1834: note = mRNA product Design c-5 comprising derived and/or modified sequence from HRSV(A2)__F-del_DSCav1_mut1 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2131 - RNA, 1834 nt, synthetic construct
  misc_feature 1..1834: note = mRNA product Design c-5 comprising derived and/or modified sequence from HRSV(A2)__F-del_DSCav1_mut1 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2132 - RNA, 1834 nt, synthetic construct
  misc_feature 1..1834: note = mRNA product Design c-5 comprising derived and/or modified sequence from HRSV(A2)__F-del_DSCav1_mut1 (opt6)
  source 1..1834: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2133 - RNA, 1834 nt, synthetic construct
  misc_feature 1..1834: note = mRNA product Design c-5 comprising derived and/or modified sequence from HRSV(A2)__F-del_DSCav1_mut1 (opt11)
  source 1..1834: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2134 - RNA, 1843 nt, synthetic construct
  misc_feature 1..1843: note = mRNA product Design d-1 comprising derived and/or modified sequence from HRSV(A2)__F-del_DSCav1_mut1 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2135 - RNA, 1843 nt, synthetic construct
  misc_feature 1..1843: note = mRNA product Design d-1 comprising derived and/or modified sequence from HRSV(A2)__F-del_DSCav1_mut1 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2136 - RNA, 1843 nt, synthetic construct
  misc_feature 1..1843: note = mRNA product Design d-1 comprising derived and/or modified sequence from HRSV(A2)__F-del_DSCav1_mut1 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2137 - RNA, 1843 nt, synthetic construct
  misc_feature 1..1843: note = mRNA product Design d-1 comprising derived and/or modified sequence from HRSV(A2)__F-del_DSCav1_mut1 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2138 - RNA, 1843 nt, synthetic construct
  misc_feature 1..1843: note = mRNA product Design d-1 comprising derived and/or modified sequence from HRSV(A2)__F-del_DSCav1_mut1 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2139 - RNA, 1843 nt, synthetic construct
  misc_feature 1..1843: note = mRNA product Design d-1 comprising derived and/or modified sequence from HRSV(A2)__F-del_DSCav1_mut1 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2140 - RNA, 1843 nt, synthetic construct
  misc_feature 1..1843: note = mRNA product Design d-1 comprising derived and/or modified sequence from HRSV(A2)__F-del_DSCav1_mut1 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2141 - RNA, 1843 nt, synthetic construct
  misc_feature 1..1843: note = mRNA product Design d-1 comprising derived and/or modified sequence from HRSV(A2)__F-del_DSCav1_mut1 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2142 - RNA, 1898 nt, synthetic construct
  misc_feature 1..1898: note = mRNA product Design d-2 comprising derived and/or modified sequence from HRSV(A2)__F-del_DSCav1_mut1 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2143 - RNA, 1898 nt, synthetic construct
  misc_feature 1..1898: note = mRNA product Design d-2 comprising derived and/or modified sequence from HRSV(A2)__F-del_DSCav1_mut1 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2144 - RNA, 1898 nt, synthetic construct
  misc_feature 1..1898: note = mRNA product Design d-2 comprising derived and/or modified sequence from HRSV(A2)__F-del_DSCav1_mut1 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2145 - RNA, 1898 nt, synthetic construct
  misc_feature 1..1898: note = mRNA product Design d-2 comprising derived and/or modified sequence from HRSV(A2)__F-del_DSCav1_mut1 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2146 - RNA, 1898 nt, synthetic construct
  misc_feature 1..1898: note = mRNA product Design d-2 comprising derived and/or modified sequence from HRSV(A2)__F-del_DSCav1_mut1 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2147 - RNA, 1898 nt, synthetic construct
  misc_feature 1..1898: note = mRNA product Design d-2 comprising derived and/or modified sequence from HRSV(A2)__F-del_DSCav1_mut1 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2148 - RNA, 1898 nt, synthetic construct
  misc_feature 1..1898: note = mRNA product Design d-2 comprising derived and/or modified sequence from HRSV(A2)__F-del_DSCav1_mut1 (opt6)
  source 1..1898: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2149 - RNA, 1898 nt, synthetic construct
  misc_feature 1..1898: note = mRNA product Design d-2 comprising derived and/or modified sequence from HRSV(A2)__F-del_DSCav1_mut1 (opt11)
  source 1..1898: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2150 - RNA, 2214 nt, synthetic construct
  misc_feature 1..2214: note = mRNA product Design d-3 comprising derived and/or modified sequence from HRSV(A2)__F-del_DSCav1_mut1 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2151 - RNA, 2214 nt, synthetic construct
  misc_feature 1..2214: note = mRNA product Design d-3 comprising derived and/or modified sequence from HRSV(A2)__F-del_DSCav1_mut1 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2152 - RNA, 2214 nt, synthetic construct
  misc_feature 1..2214: note = mRNA product Design d-3 comprising derived and/or modified sequence from HRSV(A2)__F-del_DSCav1_mut1 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2153 - RNA, 2214 nt, synthetic construct
  misc_feature 1..2214: note = mRNA product Design d-3 comprising derived and/or modified sequence from HRSV(A2)__F-del_DSCav1_mut1 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2154 - RNA, 2214 nt, synthetic construct
  misc_feature 1..2214: note = mRNA product Design d-3 comprising derived and/or modified sequence from HRSV(A2)__F-del_DSCav1_mut1 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2155 - RNA, 2214 nt, synthetic construct
  misc_feature 1..2214: note = mRNA product Design d-3 comprising derived and/or modified sequence from HRSV(A2)__F-del_DSCav1_mut1 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2156 - RNA, 2214 nt, synthetic construct
  misc_feature 1..2214: note = mRNA product Design d-3 comprising derived and/or modified sequence from HRSV(A2)__F-del_DSCav1_mut1 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2157 - RNA, 2214 nt, synthetic construct
  misc_feature 1..2214: note = mRNA product Design d-3 comprising derived and/or modified sequence from HRSV(A2)__F-del_DSCav1_mut1 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2158 - RNA, 1897 nt, synthetic construct
  misc_feature 1..1897: note = mRNA product Design d-4 comprising derived and/or modified sequence from HRSV(A2)__F-del_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2159 - RNA, 1897 nt, synthetic construct
  misc_feature 1..1897: note = mRNA product Design d-4 comprising derived and/or modified sequence from HRSV(A2)__F-del_DSCav1_mut1 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2160 - RNA, 1897 nt, synthetic construct
  misc_feature 1..1897: note = mRNA product Design d-4 comprising derived and/or modified sequence from HRSV(A2)__F-del_DSCav1_mut1 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2161 - RNA, 1897 nt, synthetic construct
  misc_feature 1..1897: note = mRNA product Design d-4 comprising derived and/or modified sequence from HRSV(A2)__F-del_DSCav1_mut1 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2162 - RNA, 1897 nt, synthetic construct
  misc_feature 1..1897: note = mRNA product Design d-4 comprising derived and/or modified sequence from HRSV(A2)__F-del_DSCav1_mut1 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2163 - RNA, 1897 nt, synthetic construct
  misc_feature 1..1897: note = mRNA product Design d-4 comprising derived and/or modified sequence from HRSV(A2)__F-del_DSCav1_mut1 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2164 - RNA, 1897 nt, synthetic construct
  misc_feature 1..1897: note = mRNA product Design d-4 comprising derived and/or modified sequence from HRSV(A2)__F-del_DSCav1_mut1 (opt6)
  source 1..1897: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2165 - RNA, 1897 nt, synthetic construct
  misc_feature 1..1897: note = mRNA product Design d-4 comprising derived and/or modified sequence from HRSV(A2)__F-del_DSCav1_mut1 (opt11)
  source 1..1897: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2166 - RNA, 1994 nt, synthetic construct
  misc_feature 1..1994: note = mRNA product Design d-5 comprising derived and/or modified sequence from HRSV(A2)__F-del_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2167 - RNA, 1994 nt, synthetic construct
  misc_feature 1..1994: note = mRNA product Design d-5 comprising derived and/or modified sequence from HRSV(A2)__F-del_DSCav1_mut1 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2168 - RNA, 1994 nt, synthetic construct
  misc_feature 1..1994: note = mRNA product Design d-5 comprising derived and/or modified sequence from HRSV(A2)__F-del_DSCav1_mut1 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2169 - RNA, 1994 nt, synthetic construct
  misc_feature 1..1994: note = mRNA product Design d-5 comprising derived and/or modified sequence from HRSV(A2)__F-del_DSCav1_mut1 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2170 - RNA, 1994 nt, synthetic construct
  misc_feature 1..1994: note = mRNA product Design d-5 comprising derived and/or modified sequence from HRSV(A2)__F-del_DSCav1_mut1 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2171 - RNA, 1994 nt, synthetic construct
  misc_feature 1..1994: note = mRNA product Design d-5 comprising derived and/or modified sequence from HRSV(A2)__F-del_DSCav1_mut1 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2172 - RNA, 1994 nt, synthetic construct
  misc_feature 1..1994: note = mRNA product Design d-5 comprising derived and/or modified sequence from HRSV(A2)__F-del_DSCav1_mut1 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2173 - RNA, 1994 nt, synthetic construct
  misc_feature 1..1994: note = mRNA product Design d-5 comprising derived and/or modified sequence from HRSV(A2)__F-del_DSCav1_mut1 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2174 - RNA, 1874 nt, synthetic construct
  misc_feature 1..1874: note = mRNA product Design e-1 comprising derived and/or modified sequence from HRSV(A2)__F-del_DSCav1_mut1 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2175 - RNA, 1874 nt, synthetic construct
  misc_feature 1..1874: note = mRNA product Design e-1 comprising derived and/or modified sequence from HRSV(A2)__F-del_DSCav1_mut1 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2176 - RNA, 1874 nt, synthetic construct
  misc_feature 1..1874: note = mRNA product Design e-1 comprising derived and/or modified sequence from HRSV(A2)__F-del_DSCav1_mut1 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2177 - RNA, 1874 nt, synthetic construct
  misc_feature 1..1874: note = mRNA product Design e-1 comprising derived and/or modified sequence from HRSV(A2)__F-del_DSCav1_mut1 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2178 - RNA, 1874 nt, synthetic construct
  misc_feature 1..1874: note = mRNA product Design e-1 comprising derived and/or modified sequence from HRSV(A2)__F-del_DSCav1_mut1 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2179 - RNA, 1874 nt, synthetic construct
  misc_feature 1..1874: note = mRNA product Design e-1 comprising derived and/or modified sequence from HRSV(A2)__F-del_DSCav1_mut1 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2180 - RNA, 1874 nt, synthetic construct
  misc_feature 1..1874: note = mRNA product Design e-1 comprising derived and/or modified sequence from HRSV(A2)__F-del_DSCav1_mut1 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2181 - RNA, 1874 nt, synthetic construct
  misc_feature 1..1874: note = mRNA product Design e-1 comprising derived and/or modified sequence from HRSV(A2)__F-del_DSCav1_mut1 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2182 - RNA, 1856 nt, synthetic construct
  misc_feature 1..1856: note = mRNA product Design e-2 comprising derived and/or modified sequence from HRSV(A2)__F-del_DSCav1_mut1 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2183 - RNA, 1856 nt, synthetic construct
  misc_feature 1..1856: note = mRNA product Design e-2 comprising derived and/or modified sequence from HRSV(A2)__F-del_DSCav1_mut1 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2184 - RNA, 1856 nt, synthetic construct
  misc_feature 1..1856: note = mRNA product Design e-2 comprising derived and/or modified sequence from HRSV(A2)__F-del_DSCav1_mut1 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2185 - RNA, 1856 nt, synthetic construct
  misc_feature 1..1856: note = mRNA product Design e-2 comprising derived and/or modified sequence from HRSV(A2)__F-del_DSCav1_mut1 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2186 - RNA, 1856 nt, synthetic construct
  misc_feature 1..1856: note = mRNA product Design e-2 comprising derived and/or modified sequence from HRSV(A2)__F-del_DSCav1_mut1 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2187 - RNA, 1856 nt, synthetic construct
  misc_feature 1..1856: note = mRNA product Design e-2 comprising derived and/or modified sequence from HRSV(A2)__F-del_DSCav1_mut1 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2188 - RNA, 1856 nt, synthetic construct
  misc_feature 1..1856: note = mRNA product Design e-2 comprising derived and/or modified sequence from HRSV(A2)__F-del_DSCav1_mut1 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2189 - RNA, 1856 nt, synthetic construct
  misc_feature 1..1856: note = mRNA product Design e-2 comprising derived and/or modified sequence from HRSV(A2)__F-del_DSCav1_mut1 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2190 - RNA, 1826 nt, synthetic construct
  misc_feature 1..1826: note = mRNA product Design e-3 comprising derived and/or modified sequence from HRSV(A2)__F-del_DSCav1_mut1 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2191 - RNA, 1826 nt, synthetic construct
  misc_feature 1..1826: note = mRNA product Design e-3 comprising derived and/or modified sequence from HRSV(A2)__F-del_DSCav1_mut1 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2192 - RNA, 1826 nt, synthetic construct
  misc_feature 1..1826: note = mRNA product Design e-3 comprising derived and/or modified sequence from HRSV(A2)__F-del_DSCav1_mut1 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2193 - RNA, 1826 nt, synthetic construct
  misc_feature 1..1826: note = mRNA product Design e-3 comprising derived and/or modified sequence from HRSV(A2)__F-del_DSCav1_mut1 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2194 - RNA, 1826 nt, synthetic construct
  misc_feature 1..1826: note = mRNA product Design e-3 comprising derived and/or modified sequence from HRSV(A2)__F-del_DSCav1_mut1 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2195 - RNA, 1826 nt, synthetic construct
  misc_feature 1..1826: note = mRNA product Design e-3 comprising derived and/or modified sequence from HRSV(A2)__F-del_DSCav1_mut1 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2196 - RNA, 1826 nt, synthetic construct
  misc_feature 1..1826: note = mRNA product Design e-3 comprising derived and/or modified sequence from HRSV(A2)__F-del_DSCav1_mut1 (opt6)
  source 1..1826: mol_type = other RNA
gggagactttcccattctgtagcagaatttggtgttgcctgtggtcttggtcccgcggagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2197 - RNA, 1826 nt, synthetic construct
  misc_feature 1..1826: note = mRNA product Design e-3 comprising derived and/or modified sequence from HRSV(A2)__F-del_DSCav1_mut1 (opt11)
  source 1..1826: mol_type = other RNA
gggagactttcccattctgtagcagaatttggtgttgcctgtggtcttggtcccgcggagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2198 - RNA, 1880 nt, synthetic construct
  misc_feature 1..1880: note = mRNA product Design e-4 comprising derived and/or modified sequence from HRSV(A2)__F-del_DSCav1_mut1 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2199 - RNA, 1880 nt, synthetic construct
  misc_feature 1..1880: note = mRNA product Design e-4 comprising derived and/or modified sequence from HRSV(A2)__F-del_DSCav1_mut1 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2200 - RNA, 1880 nt, synthetic construct
  misc_feature 1..1880: note = mRNA product Design e-4 comprising derived and/or modified sequence from HRSV(A2)__F-del_DSCav1_mut1 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2201 - RNA, 1880 nt, synthetic construct
  misc_feature 1..1880: note = mRNA product Design e-4 comprising derived and/or modified sequence from HRSV(A2)__F-del_DSCav1_mut1 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2202 - RNA, 1880 nt, synthetic construct
  misc_feature 1..1880: note = mRNA product Design e-4 comprising derived and/or modified sequence from HRSV(A2)__F-del_DSCav1_mut1 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2203 - RNA, 1880 nt, synthetic construct
  misc_feature 1..1880: note = mRNA product Design e-4 comprising derived and/or modified sequence from HRSV(A2)__F-del_DSCav1_mut1 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2204 - RNA, 1880 nt, synthetic construct
  misc_feature 1..1880: note = mRNA product Design e-4 comprising derived and/or modified sequence from HRSV(A2)__F-del_DSCav1_mut1 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2205 - RNA, 1880 nt, synthetic construct
  misc_feature 1..1880: note = mRNA product Design e-4 comprising derived and/or modified sequence from HRSV(A2)__F-del_DSCav1_mut1 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2206 - RNA, 1847 nt, synthetic construct
  misc_feature 1..1847: note = mRNA product Design e-5 comprising derived and/or modified sequence from HRSV(A2)__F-del_DSCav1_mut1 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2207 - RNA, 1847 nt, synthetic construct
  misc_feature 1..1847: note = mRNA product Design e-5 comprising derived and/or modified sequence from HRSV(A2)__F-del_DSCav1_mut1 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2208 - RNA, 1847 nt, synthetic construct
  misc_feature 1..1847: note = mRNA product Design e-5 comprising derived and/or modified sequence from HRSV(A2)__F-del_DSCav1_mut1 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2209 - RNA, 1847 nt, synthetic construct
  misc_feature 1..1847: note = mRNA product Design e-5 comprising derived and/or modified sequence from HRSV(A2)__F-del_DSCav1_mut1 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2210 - RNA, 1847 nt, synthetic construct
  misc_feature 1..1847: note = mRNA product Design e-5 comprising derived and/or modified sequence from HRSV(A2)__F-del_DSCav1_mut1 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2211 - RNA, 1847 nt, synthetic construct
  misc_feature 1..1847: note = mRNA product Design e-5 comprising derived and/or modified sequence from HRSV(A2)__F-del_DSCav1_mut1 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2212 - RNA, 1847 nt, synthetic construct
  misc_feature 1..1847: note = mRNA product Design e-5 comprising derived and/or modified sequence from HRSV(A2)__F-del_DSCav1_mut1 (opt6)
  source 1..1847: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2213 - RNA, 1847 nt, synthetic construct
  misc_feature 1..1847: note = mRNA product Design e-5 comprising derived and/or modified sequence from HRSV(A2)__F-del_DSCav1_mut1 (opt11)
  source 1..1847: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2214 - RNA, 1914 nt, synthetic construct
  misc_feature 1..1914: note = mRNA product Design e-6 comprising derived and/or modified sequence from HRSV(A2)__F-del_DSCav1_mut1 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2215 - RNA, 1914 nt, synthetic construct
  misc_feature 1..1914: note = mRNA product Design e-6 comprising derived and/or modified sequence from HRSV(A2)__F-del_DSCav1_mut1 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2216 - RNA, 1914 nt, synthetic construct
  misc_feature 1..1914: note = mRNA product Design e-6 comprising derived and/or modified sequence from HRSV(A2)__F-del_DSCav1_mut1 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2217 - RNA, 1914 nt, synthetic construct
  misc_feature 1..1914: note = mRNA product Design e-6 comprising derived and/or modified sequence from HRSV(A2)__F-del_DSCav1_mut1 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2218 - RNA, 1914 nt, synthetic construct
  misc_feature 1..1914: note = mRNA product Design e-6 comprising derived and/or modified sequence from HRSV(A2)__F-del_DSCav1_mut1 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2219 - RNA, 1914 nt, synthetic construct
  misc_feature 1..1914: note = mRNA product Design e-6 comprising derived and/or modified sequence from HRSV(A2)__F-del_DSCav1_mut1 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2220 - RNA, 1914 nt, synthetic construct
  misc_feature 1..1914: note = mRNA product Design e-6 comprising derived and/or modified sequence from HRSV(A2)__F-del_DSCav1_mut1 (opt6)
  source 1..1914: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2221 - RNA, 1914 nt, synthetic construct
  misc_feature 1..1914: note = mRNA product Design e-6 comprising derived and/or modified sequence from HRSV(A2)__F-del_DSCav1_mut1 (opt11)
  source 1..1914: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2222 - RNA, 2130 nt, synthetic construct
  misc_feature 1..2130: note = mRNA product Design f-1 comprising derived and/or modified sequence from HRSV(A2)__F-del_DSCav1_mut1 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2223 - RNA, 2130 nt, synthetic construct
  misc_feature 1..2130: note = mRNA product Design f-1 comprising derived and/or modified sequence from HRSV(A2)__F-del_DSCav1_mut1 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2224 - RNA, 2130 nt, synthetic construct
  misc_feature 1..2130: note = mRNA product Design f-1 comprising derived and/or modified sequence from HRSV(A2)__F-del_DSCav1_mut1 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2225 - RNA, 2130 nt, synthetic construct
  misc_feature 1..2130: note = mRNA product Design f-1 comprising derived and/or modified sequence from HRSV(A2)__F-del_DSCav1_mut1 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2226 - RNA, 2130 nt, synthetic construct
  misc_feature 1..2130: note = mRNA product Design f-1 comprising derived and/or modified sequence from HRSV(A2)__F-del_DSCav1_mut1 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2227 - RNA, 2130 nt, synthetic construct
  misc_feature 1..2130: note = mRNA product Design f-1 comprising derived and/or modified sequence from HRSV(A2)__F-del_DSCav1_mut1 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2228 - RNA, 2130 nt, synthetic construct
  misc_feature 1..2130: note = mRNA product Design f-1 comprising derived and/or modified sequence from HRSV(A2)__F-del_DSCav1_mut1 (opt6)
  source 1..2130: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2229 - RNA, 2130 nt, synthetic construct
  misc_feature 1..2130: note = mRNA product Design f-1 comprising derived and/or modified sequence from HRSV(A2)__F-del_DSCav1_mut1 (opt11)
  source 1..2130: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2230 - RNA, 1910 nt, synthetic construct
  misc_feature 1..1910: note = mRNA product Design f-2 comprising derived and/or modified sequence from HRSV(A2)__F-del_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2231 - RNA, 1910 nt, synthetic construct
  misc_feature 1..1910: note = mRNA product Design f-2 comprising derived and/or modified sequence from HRSV(A2)__F-del_DSCav1_mut1 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2232 - RNA, 1910 nt, synthetic construct
  misc_feature 1..1910: note = mRNA product Design f-2 comprising derived and/or modified sequence from HRSV(A2)__F-del_DSCav1_mut1 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2233 - RNA, 1910 nt, synthetic construct
  misc_feature 1..1910: note = mRNA product Design f-2 comprising derived and/or modified sequence from HRSV(A2)__F-del_DSCav1_mut1 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2234 - RNA, 1910 nt, synthetic construct
  misc_feature 1..1910: note = mRNA product Design f-2 comprising derived and/or modified sequence from HRSV(A2)__F-del_DSCav1_mut1 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2235 - RNA, 1910 nt, synthetic construct
  misc_feature 1..1910: note = mRNA product Design f-2 comprising derived and/or modified sequence from HRSV(A2)__F-del_DSCav1_mut1 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2236 - RNA, 1910 nt, synthetic construct
  misc_feature 1..1910: note = mRNA product Design f-2 comprising derived and/or modified sequence from HRSV(A2)__F-del_DSCav1_mut1 (opt6)
  source 1..1910: mol_type = other RNA
gggagagcggctcggccattttgtcccagtcagtccggaggctgcggctgcagaagtaccgcctgcggagtaactgcaaagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2237 - RNA, 1910 nt, synthetic construct
  misc_feature 1..1910: note = mRNA product Design f-2 comprising derived and/or modified sequence from HRSV(A2)__F-del_DSCav1_mut1 (opt11)
  source 1..1910: mol_type = other RNA
gggagagcggctcggccattttgtcccagtcagtccggaggctgcggctgcagaagtaccgcctgcggagtaactgcaaagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2238 - RNA, 1901 nt, synthetic construct
  misc_feature 1..1901: note = mRNA product Design f-3 comprising derived and/or modified sequence from HRSV(A2)__F-del_DSCav1_mut1 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2239 - RNA, 1901 nt, synthetic construct
  misc_feature 1..1901: note = mRNA product Design f-3 comprising derived and/or modified sequence from HRSV(A2)__F-del_DSCav1_mut1 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2240 - RNA, 1901 nt, synthetic construct
  misc_feature 1..1901: note = mRNA product Design f-3 comprising derived and/or modified sequence from HRSV(A2)__F-del_DSCav1_mut1 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2241 - RNA, 1901 nt, synthetic construct
  misc_feature 1..1901: note = mRNA product Design f-3 comprising derived and/or modified sequence from HRSV(A2)__F-del_DSCav1_mut1 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2242 - RNA, 1901 nt, synthetic construct
  misc_feature 1..1901: note = mRNA product Design f-3 comprising derived and/or modified sequence from HRSV(A2)__F-del_DSCav1_mut1 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2243 - RNA, 1901 nt, synthetic construct
  misc_feature 1..1901: note = mRNA product Design f-3 comprising derived and/or modified sequence from HRSV(A2)__F-del_DSCav1_mut1 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2244 - RNA, 1901 nt, synthetic construct
  misc_feature 1..1901: note = mRNA product Design f-3 comprising derived and/or modified sequence from HRSV(A2)__F-del_DSCav1_mut1 (opt6)
  source 1..1901: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2245 - RNA, 1901 nt, synthetic construct
  misc_feature 1..1901: note = mRNA product Design f-3 comprising derived and/or modified sequence from HRSV(A2)__F-del_DSCav1_mut1 (opt11)
  source 1..1901: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2246 - RNA, 2117 nt, synthetic construct
  misc_feature 1..2117: note = mRNA product Design f-4 comprising derived and/or modified sequence from HRSV(A2)__F-del_DSCav1_mut1 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2247 - RNA, 2117 nt, synthetic construct
  misc_feature 1..2117: note = mRNA product Design f-4 comprising derived and/or modified sequence from HRSV(A2)__F-del_DSCav1_mut1 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2248 - RNA, 2117 nt, synthetic construct
  misc_feature 1..2117: note = mRNA product Design f-4 comprising derived and/or modified sequence from HRSV(A2)__F-del_DSCav1_mut1 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2249 - RNA, 2117 nt, synthetic construct
  misc_feature 1..2117: note = mRNA product Design f-4 comprising derived and/or modified sequence from HRSV(A2)__F-del_DSCav1_mut1 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2250 - RNA, 2117 nt, synthetic construct
  misc_feature 1..2117: note = mRNA product Design f-4 comprising derived and/or modified sequence from HRSV(A2)__F-del_DSCav1_mut1 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2251 - RNA, 2117 nt, synthetic construct
  misc_feature 1..2117: note = mRNA product Design f-4 comprising derived and/or modified sequence from HRSV(A2)__F-del_DSCav1_mut1 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2252 - RNA, 2117 nt, synthetic construct
  misc_feature 1..2117: note = mRNA product Design f-4 comprising derived and/or modified sequence from HRSV(A2)__F-del_DSCav1_mut1 (opt6)
  source 1..2117: mol_type = other RNA
gggagagtcccgcagtcggcgtccagcggctctgcttgttcgtgtgtgtgtcgttgcaggccttattcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2253 - RNA, 2117 nt, synthetic construct
  misc_feature 1..2117: note = mRNA product Design f-4 comprising derived and/or modified sequence from HRSV(A2)__F-del_DSCav1_mut1 (opt11)
  source 1..2117: mol_type = other RNA
gggagagtcccgcagtcggcgtccagcggctctgcttgttcgtgtgtgtgtcgttgcaggccttattcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2254 - RNA, 1893 nt, synthetic construct
  misc_feature 1..1893: note = mRNA product Design f-5 comprising derived and/or modified sequence from HRSV(A2)__F-del_DSCav1_mut1 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2255 - RNA, 1893 nt, synthetic construct
  misc_feature 1..1893: note = mRNA product Design f-5 comprising derived and/or modified sequence from HRSV(A2)__F-del_DSCav1_mut1 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2256 - RNA, 1893 nt, synthetic construct
  misc_feature 1..1893: note = mRNA product Design f-5 comprising derived and/or modified sequence from HRSV(A2)__F-del_DSCav1_mut1 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2257 - RNA, 1893 nt, synthetic construct
  misc_feature 1..1893: note = mRNA product Design f-5 comprising derived and/or modified sequence from HRSV(A2)__F-del_DSCav1_mut1 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2258 - RNA, 1893 nt, synthetic construct
  misc_feature 1..1893: note = mRNA product Design f-5 comprising derived and/or modified sequence from HRSV(A2)__F-del_DSCav1_mut1 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2259 - RNA, 1893 nt, synthetic construct
  misc_feature 1..1893: note = mRNA product Design f-5 comprising derived and/or modified sequence from HRSV(A2)__F-del_DSCav1_mut1 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2260 - RNA, 1893 nt, synthetic construct
  misc_feature 1..1893: note = mRNA product Design f-5 comprising derived and/or modified sequence from HRSV(A2)__F-del_DSCav1_mut1 (opt6)
  source 1..1893: mol_type = other RNA
gggagactttcccattctgtagcagaatttggtgttgcctgtggtcttggtcccgcggagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2261 - RNA, 1893 nt, synthetic construct
  misc_feature 1..1893: note = mRNA product Design f-5 comprising derived and/or modified sequence from HRSV(A2)__F-del_DSCav1_mut1 (opt11)
  source 1..1893: mol_type = other RNA
gggagactttcccattctgtagcagaatttggtgttgcctgtggtcttggtcccgcggagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2262 - RNA, 1889 nt, synthetic construct
  misc_feature 1..1889: note = mRNA product Design g-1 comprising derived and/or modified sequence from HRSV(A2)__F-del_DSCav1_mut1 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2263 - RNA, 1889 nt, synthetic construct
  misc_feature 1..1889: note = mRNA product Design g-1 comprising derived and/or modified sequence from HRSV(A2)__F-del_DSCav1_mut1 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2264 - RNA, 1889 nt, synthetic construct
  misc_feature 1..1889: note = mRNA product Design g-1 comprising derived and/or modified sequence from HRSV(A2)__F-del_DSCav1_mut1 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2265 - RNA, 1889 nt, synthetic construct
  misc_feature 1..1889: note = mRNA product Design g-1 comprising derived and/or modified sequence from HRSV(A2)__F-del_DSCav1_mut1 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2266 - RNA, 1889 nt, synthetic construct
  misc_feature 1..1889: note = mRNA product Design g-1 comprising derived and/or modified sequence from HRSV(A2)__F-del_DSCav1_mut1 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2267 - RNA, 1889 nt, synthetic construct
  misc_feature 1..1889: note = mRNA product Design g-1 comprising derived and/or modified sequence from HRSV(A2)__F-del_DSCav1_mut1 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2268 - RNA, 1889 nt, synthetic construct
  misc_feature 1..1889: note = mRNA product Design g-1 comprising derived and/or modified sequence from HRSV(A2)__F-del_DSCav1_mut1 (opt6)
  source 1..1889: mol_type = other RNA
gggagactttcccattctgtagcagaatttggtgttgcctgtggtcttggtcccgcggagaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2269 - RNA, 1889 nt, synthetic construct
  misc_feature 1..1889: note = mRNA product Design g-1 comprising derived and/or modified sequence from HRSV(A2)__F-del_DSCav1_mut1 (opt11)
  source 1..1889: mol_type = other RNA
gggagactttcccattctgtagcagaatttggtgttgcctgtggtcttggtcccgcggagaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2270 - RNA, 1904 nt, synthetic construct
  misc_feature 1..1904: note = mRNA product Design g-2 comprising derived and/or modified sequence from HRSV(A2)__F-del_DSCav1_mut1 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2271 - RNA, 1904 nt, synthetic construct
  misc_feature 1..1904: note = mRNA product Design g-2 comprising derived and/or modified sequence from HRSV(A2)__F-del_DSCav1_mut1 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2272 - RNA, 1904 nt, synthetic construct
  misc_feature 1..1904: note = mRNA product Design g-2 comprising derived and/or modified sequence from HRSV(A2)__F-del_DSCav1_mut1 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2273 - RNA, 1904 nt, synthetic construct
  misc_feature 1..1904: note = mRNA product Design g-2 comprising derived and/or modified sequence from HRSV(A2)__F-del_DSCav1_mut1 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2274 - RNA, 1904 nt, synthetic construct
  misc_feature 1..1904: note = mRNA product Design g-2 comprising derived and/or modified sequence from HRSV(A2)__F-del_DSCav1_mut1 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2275 - RNA, 1904 nt, synthetic construct
  misc_feature 1..1904: note = mRNA product Design g-2 comprising derived and/or modified sequence from HRSV(A2)__F-del_DSCav1_mut1 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2276 - RNA, 1904 nt, synthetic construct
  misc_feature 1..1904: note = mRNA product Design g-2 comprising derived and/or modified sequence from HRSV(A2)__F-del_DSCav1_mut1 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2277 - RNA, 1904 nt, synthetic construct
  misc_feature 1..1904: note = mRNA product Design g-2 comprising derived and/or modified sequence from HRSV(A2)__F-del_DSCav1_mut1 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2278 - RNA, 2136 nt, synthetic construct
  misc_feature 1..2136: note = mRNA product Design g-3 comprising derived and/or modified sequence from HRSV(A2)__F-del_DSCav1_mut1 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2279 - RNA, 2136 nt, synthetic construct
  misc_feature 1..2136: note = mRNA product Design g-3 comprising derived and/or modified sequence from HRSV(A2)__F-del_DSCav1_mut1 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2280 - RNA, 2136 nt, synthetic construct
  misc_feature 1..2136: note = mRNA product Design g-3 comprising derived and/or modified sequence from HRSV(A2)__F-del_DSCav1_mut1 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2281 - RNA, 2136 nt, synthetic construct
  misc_feature 1..2136: note = mRNA product Design g-3 comprising derived and/or modified sequence from HRSV(A2)__F-del_DSCav1_mut1 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2282 - RNA, 2136 nt, synthetic construct
  misc_feature 1..2136: note = mRNA product Design g-3 comprising derived and/or modified sequence from HRSV(A2)__F-del_DSCav1_mut1 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2283 - RNA, 2136 nt, synthetic construct
  misc_feature 1..2136: note = mRNA product Design g-3 comprising derived and/or modified sequence from HRSV(A2)__F-del_DSCav1_mut1 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2284 - RNA, 2136 nt, synthetic construct
  misc_feature 1..2136: note = mRNA product Design g-3 comprising derived and/or modified sequence from HRSV(A2)__F-del_DSCav1_mut1 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2285 - RNA, 2136 nt, synthetic construct
  misc_feature 1..2136: note = mRNA product Design g-3 comprising derived and/or modified sequence from HRSV(A2)__F-del_DSCav1_mut1 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2286 - RNA, 1931 nt, synthetic construct
  misc_feature 1..1931: note = mRNA product Design g-4 comprising derived and/or modified sequence from HRSV(A2)__F-del_DSCav1_mut1 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2287 - RNA, 1931 nt, synthetic construct
  misc_feature 1..1931: note = mRNA product Design g-4 comprising derived and/or modified sequence from HRSV(A2)__F-del_DSCav1_mut1 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2288 - RNA, 1931 nt, synthetic construct
  misc_feature 1..1931: note = mRNA product Design g-4 comprising derived and/or modified sequence from HRSV(A2)__F-del_DSCav1_mut1 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2289 - RNA, 1931 nt, synthetic construct
  misc_feature 1..1931: note = mRNA product Design g-4 comprising derived and/or modified sequence from HRSV(A2)__F-del_DSCav1_mut1 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2290 - RNA, 1931 nt, synthetic construct
  misc_feature 1..1931: note = mRNA product Design g-4 comprising derived and/or modified sequence from HRSV(A2)__F-del_DSCav1_mut1 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2291 - RNA, 1931 nt, synthetic construct
  misc_feature 1..1931: note = mRNA product Design g-4 comprising derived and/or modified sequence from HRSV(A2)__F-del_DSCav1_mut1 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2292 - RNA, 1931 nt, synthetic construct
  misc_feature 1..1931: note = mRNA product Design g-4 comprising derived and/or modified sequence from HRSV(A2)__F-del_DSCav1_mut1 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2293 - RNA, 1931 nt, synthetic construct
  misc_feature 1..1931: note = mRNA product Design g-4 comprising derived and/or modified sequence from HRSV(A2)__F-del_DSCav1_mut1 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2294 - RNA, 1907 nt, synthetic construct
  misc_feature 1..1907: note = mRNA product Design g-5 comprising derived and/or modified sequence from HRSV(A2)__F-del_DSCav1_mut1 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2295 - RNA, 1907 nt, synthetic construct
  misc_feature 1..1907: note = mRNA product Design g-5 comprising derived and/or modified sequence from HRSV(A2)__F-del_DSCav1_mut1 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2296 - RNA, 1907 nt, synthetic construct
  misc_feature 1..1907: note = mRNA product Design g-5 comprising derived and/or modified sequence from HRSV(A2)__F-del_DSCav1_mut1 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2297 - RNA, 1907 nt, synthetic construct
  misc_feature 1..1907: note = mRNA product Design g-5 comprising derived and/or modified sequence from HRSV(A2)__F-del_DSCav1_mut1 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2298 - RNA, 1907 nt, synthetic construct
  misc_feature 1..1907: note = mRNA product Design g-5 comprising derived and/or modified sequence from HRSV(A2)__F-del_DSCav1_mut1 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2299 - RNA, 1907 nt, synthetic construct
  misc_feature 1..1907: note = mRNA product Design g-5 comprising derived and/or modified sequence from HRSV(A2)__F-del_DSCav1_mut1 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2300 - RNA, 1907 nt, synthetic construct
  misc_feature 1..1907: note = mRNA product Design g-5 comprising derived and/or modified sequence from HRSV(A2)__F-del_DSCav1_mut1 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2301 - RNA, 1907 nt, synthetic construct
  misc_feature 1..1907: note = mRNA product Design g-5 comprising derived and/or modified sequence from HRSV(A2)__F-del_DSCav1_mut1 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2302 - RNA, 1923 nt, synthetic construct
  misc_feature 1..1923: note = mRNA product Design h-1 comprising derived and/or modified sequence from HRSV(A2)__F-del_DSCav1_mut1 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2303 - RNA, 1923 nt, synthetic construct
  misc_feature 1..1923: note = mRNA product Design h-1 comprising derived and/or modified sequence from HRSV(A2)__F-del_DSCav1_mut1 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2304 - RNA, 1923 nt, synthetic construct
  misc_feature 1..1923: note = mRNA product Design h-1 comprising derived and/or modified sequence from HRSV(A2)__F-del_DSCav1_mut1 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2305 - RNA, 1923 nt, synthetic construct
  misc_feature 1..1923: note = mRNA product Design h-1 comprising derived and/or modified sequence from HRSV(A2)__F-del_DSCav1_mut1 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2306 - RNA, 1923 nt, synthetic construct
  misc_feature 1..1923: note = mRNA product Design h-1 comprising derived and/or modified sequence from HRSV(A2)__F-del_DSCav1_mut1 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2307 - RNA, 1923 nt, synthetic construct
  misc_feature 1..1923: note = mRNA product Design h-1 comprising derived and/or modified sequence from HRSV(A2)__F-del_DSCav1_mut1 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2308 - RNA, 1923 nt, synthetic construct
  misc_feature 1..1923: note = mRNA product Design h-1 comprising derived and/or modified sequence from HRSV(A2)__F-del_DSCav1_mut1 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2309 - RNA, 1923 nt, synthetic construct
  misc_feature 1..1923: note = mRNA product Design h-1 comprising derived and/or modified sequence from HRSV(A2)__F-del_DSCav1_mut1 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2310 - RNA, 2139 nt, synthetic construct
  misc_feature 1..2139: note = mRNA product Design h-2 comprising derived and/or modified sequence from HRSV(A2)__F-del_DSCav1_mut1 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2311 - RNA, 2139 nt, synthetic construct
  misc_feature 1..2139: note = mRNA product Design h-2 comprising derived and/or modified sequence from HRSV(A2)__F-del_DSCav1_mut1 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2312 - RNA, 2139 nt, synthetic construct
  misc_feature 1..2139: note = mRNA product Design h-2 comprising derived and/or modified sequence from HRSV(A2)__F-del_DSCav1_mut1 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2313 - RNA, 2139 nt, synthetic construct
  misc_feature 1..2139: note = mRNA product Design h-2 comprising derived and/or modified sequence from HRSV(A2)__F-del_DSCav1_mut1 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2314 - RNA, 2139 nt, synthetic construct
  misc_feature 1..2139: note = mRNA product Design h-2 comprising derived and/or modified sequence from HRSV(A2)__F-del_DSCav1_mut1 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2315 - RNA, 2139 nt, synthetic construct
  misc_feature 1..2139: note = mRNA product Design h-2 comprising derived and/or modified sequence from HRSV(A2)__F-del_DSCav1_mut1 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2316 - RNA, 2139 nt, synthetic construct
  misc_feature 1..2139: note = mRNA product Design h-2 comprising derived and/or modified sequence from HRSV(A2)__F-del_DSCav1_mut1 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2317 - RNA, 2139 nt, synthetic construct
  misc_feature 1..2139: note = mRNA product Design h-2 comprising derived and/or modified sequence from HRSV(A2)__F-del_DSCav1_mut1 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2318 - RNA, 1919 nt, synthetic construct
  misc_feature 1..1919: note = mRNA product Design h-3 comprising derived and/or modified sequence from HRSV(A2)__F-del_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2319 - RNA, 1919 nt, synthetic construct
  misc_feature 1..1919: note = mRNA product Design h-3 comprising derived and/or modified sequence from HRSV(A2)__F-del_DSCav1_mut1 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2320 - RNA, 1919 nt, synthetic construct
  misc_feature 1..1919: note = mRNA product Design h-3 comprising derived and/or modified sequence from HRSV(A2)__F-del_DSCav1_mut1 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2321 - RNA, 1919 nt, synthetic construct
  misc_feature 1..1919: note = mRNA product Design h-3 comprising derived and/or modified sequence from HRSV(A2)__F-del_DSCav1_mut1 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2322 - RNA, 1919 nt, synthetic construct
  misc_feature 1..1919: note = mRNA product Design h-3 comprising derived and/or modified sequence from HRSV(A2)__F-del_DSCav1_mut1 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2323 - RNA, 1919 nt, synthetic construct
  misc_feature 1..1919: note = mRNA product Design h-3 comprising derived and/or modified sequence from HRSV(A2)__F-del_DSCav1_mut1 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2324 - RNA, 1919 nt, synthetic construct
  misc_feature 1..1919: note = mRNA product Design h-3 comprising derived and/or modified sequence from HRSV(A2)__F-del_DSCav1_mut1 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2325 - RNA, 1919 nt, synthetic construct
  misc_feature 1..1919: note = mRNA product Design h-3 comprising derived and/or modified sequence from HRSV(A2)__F-del_DSCav1_mut1 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2326 - RNA, 1982 nt, synthetic construct
  misc_feature 1..1982: note = mRNA product Design h-4 comprising derived and/or modified sequence from HRSV(A2)__F-del_DSCav1_mut1 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2327 - RNA, 1982 nt, synthetic construct
  misc_feature 1..1982: note = mRNA product Design h-4 comprising derived and/or modified sequence from HRSV(A2)__F-del_DSCav1_mut1 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2328 - RNA, 1982 nt, synthetic construct
  misc_feature 1..1982: note = mRNA product Design h-4 comprising derived and/or modified sequence from HRSV(A2)__F-del_DSCav1_mut1 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2329 - RNA, 1982 nt, synthetic construct
  misc_feature 1..1982: note = mRNA product Design h-4 comprising derived and/or modified sequence from HRSV(A2)__F-del_DSCav1_mut1 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2330 - RNA, 1982 nt, synthetic construct
  misc_feature 1..1982: note = mRNA product Design h-4 comprising derived and/or modified sequence from HRSV(A2)__F-del_DSCav1_mut1 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2331 - RNA, 1982 nt, synthetic construct
  misc_feature 1..1982: note = mRNA product Design h-4 comprising derived and/or modified sequence from HRSV(A2)__F-del_DSCav1_mut1 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2332 - RNA, 1982 nt, synthetic construct
  misc_feature 1..1982: note = mRNA product Design h-4 comprising derived and/or modified sequence from HRSV(A2)__F-del_DSCav1_mut1 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2333 - RNA, 1982 nt, synthetic construct
  misc_feature 1..1982: note = mRNA product Design h-4 comprising derived and/or modified sequence from HRSV(A2)__F-del_DSCav1_mut1 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2334 - RNA, 1998 nt, synthetic construct
  misc_feature 1..1998: note = mRNA product Design h-5 comprising derived and/or modified sequence from HRSV(A2)__F-del_DSCav1_mut1 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2335 - RNA, 1998 nt, synthetic construct
  misc_feature 1..1998: note = mRNA product Design h-5 comprising derived and/or modified sequence from HRSV(A2)__F-del_DSCav1_mut1 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2336 - RNA, 1998 nt, synthetic construct
  misc_feature 1..1998: note = mRNA product Design h-5 comprising derived and/or modified sequence from HRSV(A2)__F-del_DSCav1_mut1 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2337 - RNA, 1998 nt, synthetic construct
  misc_feature 1..1998: note = mRNA product Design h-5 comprising derived and/or modified sequence from HRSV(A2)__F-del_DSCav1_mut1 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2338 - RNA, 1998 nt, synthetic construct
  misc_feature 1..1998: note = mRNA product Design h-5 comprising derived and/or modified sequence from HRSV(A2)__F-del_DSCav1_mut1 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2339 - RNA, 1998 nt, synthetic construct
  misc_feature 1..1998: note = mRNA product Design h-5 comprising derived and/or modified sequence from HRSV(A2)__F-del_DSCav1_mut1 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2340 - RNA, 1998 nt, synthetic construct
  misc_feature 1..1998: note = mRNA product Design h-5 comprising derived and/or modified sequence from HRSV(A2)__F-del_DSCav1_mut1 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2341 - RNA, 1998 nt, synthetic construct
  misc_feature 1..1998: note = mRNA product Design h-5 comprising derived and/or modified sequence from HRSV(A2)__F-del_DSCav1_mut1 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2342 - RNA, 1931 nt, synthetic construct
  misc_feature 1..1931: note = mRNA product Design i-1 comprising derived and/or modified sequence from HRSV(A2)__F-del_DSCav1_mut1 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2343 - RNA, 1931 nt, synthetic construct
  misc_feature 1..1931: note = mRNA product Design i-1 comprising derived and/or modified sequence from HRSV(A2)__F-del_DSCav1_mut1 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2344 - RNA, 1931 nt, synthetic construct
  misc_feature 1..1931: note = mRNA product Design i-1 comprising derived and/or modified sequence from HRSV(A2)__F-del_DSCav1_mut1 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2345 - RNA, 1931 nt, synthetic construct
  misc_feature 1..1931: note = mRNA product Design i-1 comprising derived and/or modified sequence from HRSV(A2)__F-del_DSCav1_mut1 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2346 - RNA, 1931 nt, synthetic construct
  misc_feature 1..1931: note = mRNA product Design i-1 comprising derived and/or modified sequence from HRSV(A2)__F-del_DSCav1_mut1 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2347 - RNA, 1931 nt, synthetic construct
  misc_feature 1..1931: note = mRNA product Design i-1 comprising derived and/or modified sequence from HRSV(A2)__F-del_DSCav1_mut1 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2348 - RNA, 1931 nt, synthetic construct
  misc_feature 1..1931: note = mRNA product Design i-1 comprising derived and/or modified sequence from HRSV(A2)__F-del_DSCav1_mut1 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2349 - RNA, 1931 nt, synthetic construct
  misc_feature 1..1931: note = mRNA product Design i-1 comprising derived and/or modified sequence from HRSV(A2)__F-del_DSCav1_mut1 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2350 - RNA, 1931 nt, synthetic construct
  misc_feature 1..1931: note = mRNA product Design i-2 comprising derived and/or modified sequence from HRSV(A2)__F-del_DSCav1_mut1 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2351 - RNA, 1931 nt, synthetic construct
  misc_feature 1..1931: note = mRNA product Design i-2 comprising derived and/or modified sequence from HRSV(A2)__F-del_DSCav1_mut1 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2352 - RNA, 1931 nt, synthetic construct
  misc_feature 1..1931: note = mRNA product Design i-2 comprising derived and/or modified sequence from HRSV(A2)__F-del_DSCav1_mut1 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2353 - RNA, 1931 nt, synthetic construct
  misc_feature 1..1931: note = mRNA product Design i-2 comprising derived and/or modified sequence from HRSV(A2)__F-del_DSCav1_mut1 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2354 - RNA, 1931 nt, synthetic construct
  misc_feature 1..1931: note = mRNA product Design i-2 comprising derived and/or modified sequence from HRSV(A2)__F-del_DSCav1_mut1 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2355 - RNA, 1931 nt, synthetic construct
  misc_feature 1..1931: note = mRNA product Design i-2 comprising derived and/or modified sequence from HRSV(A2)__F-del_DSCav1_mut1 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2356 - RNA, 1931 nt, synthetic construct
  misc_feature 1..1931: note = mRNA product Design i-2 comprising derived and/or modified sequence from HRSV(A2)__F-del_DSCav1_mut1 (opt6)
  source 1..1931: mol_type = other RNA
gggagaggcgctgcctacggaggtggcagccatctccttctcggcatcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2357 - RNA, 1931 nt, synthetic construct
  misc_feature 1..1931: note = mRNA product Design i-2 comprising derived and/or modified sequence from HRSV(A2)__F-del_DSCav1_mut1 (opt11)
  source 1..1931: mol_type = other RNA
gggagaggcgctgcctacggaggtggcagccatctccttctcggcatcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2358 - RNA, 1927 nt, synthetic construct
  misc_feature 1..1927: note = mRNA product Design i-2 comprising derived and/or modified sequence from HRSV(A2)__F-del_DSCav1_mut1 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2359 - RNA, 1927 nt, synthetic construct
  misc_feature 1..1927: note = mRNA product Design i-2 comprising derived and/or modified sequence from HRSV(A2)__F-del_DSCav1_mut1 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2360 - RNA, 1927 nt, synthetic construct
  misc_feature 1..1927: note = mRNA product Design i-2 comprising derived and/or modified sequence from HRSV(A2)__F-del_DSCav1_mut1 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2361 - RNA, 1927 nt, synthetic construct
  misc_feature 1..1927: note = mRNA product Design i-2 comprising derived and/or modified sequence from HRSV(A2)__F-del_DSCav1_mut1 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2362 - RNA, 1927 nt, synthetic construct
  misc_feature 1..1927: note = mRNA product Design i-2 comprising derived and/or modified sequence from HRSV(A2)__F-del_DSCav1_mut1 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2363 - RNA, 1927 nt, synthetic construct
  misc_feature 1..1927: note = mRNA product Design i-2 comprising derived and/or modified sequence from HRSV(A2)__F-del_DSCav1_mut1 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2364 - RNA, 1927 nt, synthetic construct
  misc_feature 1..1927: note = mRNA product Design i-2 comprising derived and/or modified sequence from HRSV(A2)__F-del_DSCav1_mut1 (opt6)
  source 1..1927: mol_type = other RNA
ggggcgctgcctacggaggtggcagccatctccttctcggcatcaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2365 - RNA, 1927 nt, synthetic construct
  misc_feature 1..1927: note = mRNA product Design i-2 comprising derived and/or modified sequence from HRSV(A2)__F-del_DSCav1_mut1 (opt11)
  source 1..1927: mol_type = other RNA
ggggcgctgcctacggaggtggcagccatctccttctcggcatcaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2366 - RNA, 1762 nt, synthetic construct
  misc_feature 1..1762: note = mRNA product Design i-3 comprising derived and/or modified sequence from HRSV(A2)__F-del_DSCav1_mut1 (opt1) R6774
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2367 - RNA, 1762 nt, synthetic construct
  misc_feature 1..1762: note = mRNA product Design i-3 comprising derived and/or modified sequence from HRSV(A2)__F-del_DSCav1_mut1 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2368 - RNA, 1762 nt, synthetic construct
  misc_feature 1..1762: note = mRNA product Design i-3 comprising derived and/or modified sequence from HRSV(A2)__F-del_DSCav1_mut1 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2369 - RNA, 1762 nt, synthetic construct
  misc_feature 1..1762: note = mRNA product Design i-3 comprising derived and/or modified sequence from HRSV(A2)__F-del_DSCav1_mut1 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgagctgcagcttctgatgcagtccacacccgccaccgggtctggatcggctatatgttcaggcgtggcagtctgcaaggtgttgcacctcgagggtgaagttaacaaaatcaagagcgccctgctgagtacgaataaagctgtggtctccctctctaacggggtgagcgtattaacttttaaggttctggaccttaagaattacattgataaacaattgctgcctatcctaaacaagcagtcctgttcaattccaaatatcgagaccgtgatagagttccagcagaaaaacaataggctcctggaaattacacgggagtttagtgtcaacgccggagtgactaccccggtgagcacatatatgcttaccaattctgaactgttgtccctcatcaacgacatgcccattacgaacgatcaaaagaaactgatgtcaaataacgtccagatcgttcgccagcagagctacagtatcatgtgcattataaaggaggaagtgttagcgtatgtagtgcaactgcctctctacggcgtcatcgacactccatgttggaaacttcatacatctcccctgtgcaccactaatacaaaggagggctccaacatttgtttgacccgaacggatcgtgggtggtactgcgacaatgcaggaagcgtgtcgttctttcctcaggccgaaacctgtaaggttcagtctaacagagtgttctgcgatacaatgaactccctaactctgccatcagaggtcaatctctgcaatgtggacatctttaaccccaaatatgattgtaagataatgaccagtaaaacagacgtaagctcctctgttattactagcctgggtgctatcgtgtcatgctacggcaagaccaaatgtacagccagtaataagaacagggggatcattaagaccttctccaatggatgcgattatgtcagcaacaaaggcgtggacactgtctctgtgggtaatacgctttactgtgttaacaagcaagaggggcagtcactgtatgtgaaaggagaacctatcattaacttttacgacccattggtattcccgagtgatgagtttgacgcaagcatatcccaggtcaatgaaaagatcaaccagtctctcgctttcattcggaaatcggatgagctgttacacaatgtgaacgccggcaagagcacaaccaatatcatgatcactaccattataatcgttattatcgtgattctgctatccctcatcgcggtcggcctgcttttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2370 - RNA, 1762 nt, synthetic construct
  misc_feature 1..1762: note = mRNA product Design i-3 comprising derived and/or modified sequence from HRSV(A2)__F-del_DSCav1_mut1 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2371 - RNA, 1762 nt, synthetic construct
  misc_feature 1..1762: note = mRNA product Design i-3 comprising derived and/or modified sequence from HRSV(A2)__F-del_DSCav1_mut1 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggagctccagctgctgatgcagagcacccccgccacaggatccggctctgctatttgtagcggggtcgccgtgtgcaaggttctccacctggagggagaagtgaacaaaatcaagtccgcgcttctgagcaccaataaagccgtcgtgtctctctccaacggcgttagcgtgctgacatttaaggtccttgacctgaagaattacattgataaacaactcctgcctatcctgaacaagcagtcttgttccattccgaatatcgagaccgtgattgagttccagcagaaaaacaatcggctcctggaaatcacgcgcgagtttagcgtgaacgctggcgtcacaacccccgtttctacatatatgcttaccaattccgaactgctcagcctgatcaacgacatgcctattaccaacgatcaaaagaaacttatgtccaataacgtgcagatcgtgagacagcagtcttacagcattatgtgcatcattaaggaggaagtcctggcctatgtggttcaactccccctgtacggggtgatcgacacaccttgttggaaactgcatacgagccccctctgcaccacaaataccaaggagggatccaacatctgtctgacacggaccgatcgcggctggtactgcgacaatgctgggtctgtctccttctttcctcaggccgaaacgtgtaaggtgcagagcaacagagttttctgcgatacaatgaactctcttaccctgccgagcgaggtgaatctctgcaatgtcgacatttttaaccccaaatatgattgtaagatcatgacctccaaaacagacgtgtctagctccgtcattaccagcctgggagcgatcgtgtcttgctacggcaagacaaaatgtacggcctccaataagaaccgggggattatcaagaccttcagcaatggatgcgattatgtttctaacaaaggcgtggacacagtctccgtgggcaataccctttactgtgttaacaagcaagaggggcagagcctgtatgtgaaaggagaacctatcattaacttttacgaccccctcgtcttcccttccgatgagtttgacgcttctatcagccaggtgaatgaaaagattaaccagtccctggccttcatccgcaaatctgatgagctgctccacaatgtgaacgctggcaagagcacaaccaatattatgatcacgaccattatcatcgttattatcgtcattctgctttccctgatcgccgtggggctcctgctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2372 - RNA, 1762 nt, synthetic construct
  misc_feature 1..1762: note = mRNA product Design i-3 comprising derived and/or modified sequence from HRSV(A2)__F-del_DSCav1_mut1 (opt6)
  source 1..1762: mol_type = other RNA
gggagaaagcttaccatggaactactcatcttaaaagcaaacgcaataacaactattctaaccgcagtaacattttgtttcgcatcaggacaaaacataaccgaagaattttaccaatcaacatgttccgcagtttcaaaaggatacttaggcgcactaagaacaggctggtacacctccgtgataacaatagaattatcaaacataaaagaaaacaaatgtaatggaactgacgccaaagtaaaactaataaaacaagaactagacaaatataaaaacgcagtaactgaactacaattactaatgcaatccaccccagcaacaggctcaggctcagcaatttgctccggagtcgctgtctgcaaagtactacatcttgaaggcgaagtcaataaaataaaatcagcacttctatcaacaaacaaagcagtagtctcactatcaaacggagtatcagtactaacatttaaagtattagatctaaaaaactatatagataaacaactactacccatactcaataaacaatcctgttcaataccaaatatagaaaccgtaatagaatttcaacaaaaaaacaatcgactattagaaatcacccgagaattttcagtcaatgcaggcgtaacaacaccagtatcaacctacatgttaaccaactccgaactactatccctcataaacgacatgccaataacaaacgatcaaaaaaaactaatgtccaacaacgtacaaatagtcagacaacaatcttattcaataatgtgcatcataaaagaagaagttctagcctacgtagttcaacttccattatacggcgtaattgatacaccatgctggaaactacacacatccccactatgtacaacaaacacaaaagaaggatcaaacatctgcttaactagaacagacagaggatggtactgcgacaacgcaggatcagtctcattctttccacaagcagaaacatgcaaggtccaatcaaacagagtattctgcgacacaatgaactccttaacactaccatctgaagtaaacctatgtaatgtagacatatttaacccaaaatacgactgcaaaataatgacctcaaaaacagacgtatcctcatcagtaattacaagcctcggagccatagtatcatgctacggaaaaacaaaatgtacagcatcaaacaaaaacagaggaataataaaaacgttctccaacggatgcgactatgtatcaaacaaaggcgtagacacagtatcagtcggaaataccctttactgcgtaaacaaacaagaaggccaaagtctatacgtaaaaggagagccaataataaacttttatgacccccttgtattcccatctgacgaatttgatgcatcaatatcccaagtcaacgaaaaaatcaaccaatcattagcctttattagaaaaagtgacgaactattacacaacgttaatgcagggaaatcaacaacaaatataatgattacaaccataattatagttatcatagttatactactctcactaatcgcagtaggattactattatactgcaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2373 - RNA, 1762 nt, synthetic construct
  misc_feature 1..1762: note = mRNA product Design i-3 comprising derived and/or modified sequence from HRSV(A2)__F-del_DSCav1_mut1 (opt11)
  source 1..1762: mol_type = other RNA
gggagaaagcttaccatggaactactcatcctaaaagccaacgcaatcacaaccatacttacagctgttaccttctgcttcgcatccggccaaaatatcaccgaagagttctaccaatcaacctgctccgccgtcagcaaaggatacctcggcgccctccgaaccggatggtacacttctgtcatcacaatcgaactctccaacatcaaagaaaacaaatgcaacggtaccgacgcgaaagtcaaactcatcaaacaagaactagacaagtacaaaaacgccgtcaccgaactgcaactcctcatgcaatccacaccagcaacgggatcaggatccgccatctgctcaggcgtcgccgtctgcaaagtcctgcacctagaaggagaagtaaacaaaattaaatccgccctactctccaccaacaaagcagtcgtctcactatccaacggcgtctccgtcctcacctttaaggtcctcgacctcaaaaattatatagacaaacaactcctccccatcctaaacaaacaatcatgctccatccccaacatagaaaccgtcatcgaatttcaacagaaaaacaaccgactcttagaaattacccgcgagttcagcgtcaacgccggagtcaccacacccgtctcaacctacatgctcaccaactcagaactcctctcactaatcaatgatatgcccatcacaaacgaccaaaagaaactcatgtccaacaacgtacaaatcgttcgccaacaaagctactccatcatgtgtatcattaaagaagaagtcctcgcctacgtcgtccaacttccgctctacggcgtaatcgacaccccctgctggaaacttcacacctcgcccctctgcaccacaaacaccaaagaaggctccaacatctgcctaacccgcaccgaccgcggctggtactgcgacaacgccggctccgtctcatttttcccccaggcggagacctgcaaagtccaatccaaccgcgtcttctgcgacaccatgaactctcttaccctcccatcagaagtaaacctctgcaacgtcgacatctttaaccccaaatacgattgcaagataatgacctccaaaacagacgtctcatcgtccgtcatcacctccctaggagctatcgtctcctgctacggcaagaccaaatgcaccgcttccaacaaaaaccgcggcatcatcaaaaccttctccaacgggtgcgactacgtctctaacaaaggcgtggacacagtatccgtaggaaacacactgtactgcgtaaacaaacaagagggccaatcgctttacgtcaaaggcgagccaattatcaacttctacgacccgctcgtcttcccatcagacgagttcgacgcatccatctcccaagtcaacgagaaaatcaatcagtccctcgccttcatacgcaaatccgacgaactcctacataacgtaaacgccggcaaatctaccacaaacatcatgatcacaaccatcatcatcgtaatcatcgtcatccttctctcgctcatcgccgtaggactgctactttactgcaaggcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2374 - protein, 535 aa, synthetic construct
  REGION 1..535: note = derived and/or modified protein sequence (artificial) from HRSV(A2)__F_DSCav1_mut2
MELLILKANAITTILTAVTFCFASGQNITEEFYQSTCSAVSKGYLGALRTGWYTSVITIELSNIKENKCNGTDAKVKLIKQELDKYKNAVTDLQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 2375 - RNA, 1608 nt, synthetic construct
  misc_feature 1..1608: note = derived and/or modified CDS sequence (opt1) from HRSV(A2)__F_DSCav1_mut2
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 2376 - RNA, 1608 nt, synthetic construct
  misc_feature 1..1608: note = derived and/or modified CDS sequence (opt1) from HRSV(A2)__F_DSCav1_mut2
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactga

SEQ ID NO: 2377 - RNA, 1608 nt, synthetic construct
  misc_feature 1..1608: note = derived and/or modified CDS sequence (opt2) from HRSV(A2)__F_DSCav1_mut2
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 2378 - RNA, 1608 nt, synthetic construct
  misc_feature 1..1608: note = derived and/or modified CDS sequence (opt3) from HRSV(A2)__F_DSCav1_mut2
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactga

SEQ ID NO: 2379 - RNA, 1608 nt, synthetic construct
  misc_feature 1..1608: note = derived and/or modified CDS sequence (opt4) from HRSV(A2)__F_DSCav1_mut2
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 2380 - RNA, 1608 nt, synthetic construct
  misc_feature 1..1608: note = derived and/or modified CDS sequence (opt5) from HRSV(A2)__F_DSCav1_mut2
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactga

SEQ ID NO: 2381 - RNA, 1608 nt, synthetic construct
  misc_feature 1..1608: note = derived and/or modified CDS sequence (opt6) from HRSV(A2)__F_DSCav1_mut2
  source 1..1608: mol_type = other RNA
atggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaa

SEQ ID NO: 2382 - RNA, 1608 nt, synthetic construct
  misc_feature 1..1608: note = derived and/or modified CDS sequence (opt11) from HRSV(A2)__F_DSCav1_mut2
  source 1..1608: mol_type = other RNA
atggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaa

SEQ ID NO: 2383 - RNA, 1884 nt, synthetic construct
  misc_feature 1..1884: note = mRNA product Design a-1 comprising derived and/or modified sequence from HRSV(A2)__F_DSCav1_mut2 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2384 - RNA, 1884 nt, synthetic construct
  misc_feature 1..1884: note = mRNA product Design a-1 comprising derived and/or modified sequence from HRSV(A2)__F_DSCav1_mut2 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2385 - RNA, 1884 nt, synthetic construct
  misc_feature 1..1884: note = mRNA product Design a-1 comprising derived and/or modified sequence from HRSV(A2)__F_DSCav1_mut2 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2386 - RNA, 1884 nt, synthetic construct
  misc_feature 1..1884: note = mRNA product Design a-1 comprising derived and/or modified sequence from HRSV(A2)__F_DSCav1_mut2 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2387 - RNA, 1884 nt, synthetic construct
  misc_feature 1..1884: note = mRNA product Design a-1 comprising derived and/or modified sequence from HRSV(A2)__F_DSCav1_mut2 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2388 - RNA, 1884 nt, synthetic construct
  misc_feature 1..1884: note = mRNA product Design a-1 comprising derived and/or modified sequence from HRSV(A2)__F_DSCav1_mut2 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2389 - RNA, 1884 nt, synthetic construct
  misc_feature 1..1884: note = mRNA product Design a-1 comprising derived and/or modified sequence from HRSV(A2)__F_DSCav1_mut2 (opt6)
  source 1..1884: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2390 - RNA, 1884 nt, synthetic construct
  misc_feature 1..1884: note = mRNA product Design a-1 comprising derived and/or modified sequence from HRSV(A2)__F_DSCav1_mut2 (opt11)
  source 1..1884: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2391 - RNA, 1903 nt, synthetic construct
  misc_feature 1..1903: note = mRNA product Design a-2 comprising derived and/or modified sequence from HRSV(A2)__F_DSCav1_mut2 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2392 - RNA, 1903 nt, synthetic construct
  misc_feature 1..1903: note = mRNA product Design a-2 comprising derived and/or modified sequence from HRSV(A2)__F_DSCav1_mut2 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2393 - RNA, 1903 nt, synthetic construct
  misc_feature 1..1903: note = mRNA product Design a-2 comprising derived and/or modified sequence from HRSV(A2)__F_DSCav1_mut2 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2394 - RNA, 1903 nt, synthetic construct
  misc_feature 1..1903: note = mRNA product Design a-2 comprising derived and/or modified sequence from HRSV(A2)__F_DSCav1_mut2 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2395 - RNA, 1903 nt, synthetic construct
  misc_feature 1..1903: note = mRNA product Design a-2 comprising derived and/or modified sequence from HRSV(A2)__F_DSCav1_mut2 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2396 - RNA, 1903 nt, synthetic construct
  misc_feature 1..1903: note = mRNA product Design a-2 comprising derived and/or modified sequence from HRSV(A2)__F_DSCav1_mut2 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2397 - RNA, 1903 nt, synthetic construct
  misc_feature 1..1903: note = mRNA product Design a-2 comprising derived and/or modified sequence from HRSV(A2)__F_DSCav1_mut2 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2398 - RNA, 1903 nt, synthetic construct
  misc_feature 1..1903: note = mRNA product Design a-2 comprising derived and/or modified sequence from HRSV(A2)__F_DSCav1_mut2 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2399 - RNA, 1981 nt, synthetic construct
  misc_feature 1..1981: note = mRNA product Design a-3 comprising derived and/or modified sequence from HRSV(A2)__F_DSCav1_mut2 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2400 - RNA, 1981 nt, synthetic construct
  misc_feature 1..1981: note = mRNA product Design a-3 comprising derived and/or modified sequence from HRSV(A2)__F_DSCav1_mut2 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2401 - RNA, 1981 nt, synthetic construct
  misc_feature 1..1981: note = mRNA product Design a-3 comprising derived and/or modified sequence from HRSV(A2)__F_DSCav1_mut2 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2402 - RNA, 1981 nt, synthetic construct
  misc_feature 1..1981: note = mRNA product Design a-3 comprising derived and/or modified sequence from HRSV(A2)__F_DSCav1_mut2 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2403 - RNA, 1981 nt, synthetic construct
  misc_feature 1..1981: note = mRNA product Design a-3 comprising derived and/or modified sequence from HRSV(A2)__F_DSCav1_mut2 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2404 - RNA, 1981 nt, synthetic construct
  misc_feature 1..1981: note = mRNA product Design a-3 comprising derived and/or modified sequence from HRSV(A2)__F_DSCav1_mut2 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2405 - RNA, 1981 nt, synthetic construct
  misc_feature 1..1981: note = mRNA product Design a-3 comprising derived and/or modified sequence from HRSV(A2)__F_DSCav1_mut2 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2406 - RNA, 1981 nt, synthetic construct
  misc_feature 1..1981: note = mRNA product Design a-3 comprising derived and/or modified sequence from HRSV(A2)__F_DSCav1_mut2 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2407 - RNA, 1930 nt, synthetic construct
  misc_feature 1..1930: note = mRNA product Design a-4 comprising derived and/or modified sequence from HRSV(A2)__F_DSCav1_mut2 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2408 - RNA, 1930 nt, synthetic construct
  misc_feature 1..1930: note = mRNA product Design a-4 comprising derived and/or modified sequence from HRSV(A2)__F_DSCav1_mut2 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2409 - RNA, 1930 nt, synthetic construct
  misc_feature 1..1930: note = mRNA product Design a-4 comprising derived and/or modified sequence from HRSV(A2)__F_DSCav1_mut2 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2410 - RNA, 1930 nt, synthetic construct
  misc_feature 1..1930: note = mRNA product Design a-4 comprising derived and/or modified sequence from HRSV(A2)__F_DSCav1_mut2 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2411 - RNA, 1930 nt, synthetic construct
  misc_feature 1..1930: note = mRNA product Design a-4 comprising derived and/or modified sequence from HRSV(A2)__F_DSCav1_mut2 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2412 - RNA, 1930 nt, synthetic construct
  misc_feature 1..1930: note = mRNA product Design a-4 comprising derived and/or modified sequence from HRSV(A2)__F_DSCav1_mut2 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2413 - RNA, 1930 nt, synthetic construct
  misc_feature 1..1930: note = mRNA product Design a-4 comprising derived and/or modified sequence from HRSV(A2)__F_DSCav1_mut2 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2414 - RNA, 1930 nt, synthetic construct
  misc_feature 1..1930: note = mRNA product Design a-4 comprising derived and/or modified sequence from HRSV(A2)__F_DSCav1_mut2 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2415 - RNA, 1876 nt, synthetic construct
  misc_feature 1..1876: note = mRNA product Design a-5 comprising derived and/or modified sequence from HRSV(A2)__F_DSCav1_mut2 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2416 - RNA, 1876 nt, synthetic construct
  misc_feature 1..1876: note = mRNA product Design a-5 comprising derived and/or modified sequence from HRSV(A2)__F_DSCav1_mut2 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2417 - RNA, 1876 nt, synthetic construct
  misc_feature 1..1876: note = mRNA product Design a-5 comprising derived and/or modified sequence from HRSV(A2)__F_DSCav1_mut2 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2418 - RNA, 1876 nt, synthetic construct
  misc_feature 1..1876: note = mRNA product Design a-5 comprising derived and/or modified sequence from HRSV(A2)__F_DSCav1_mut2 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2419 - RNA, 1876 nt, synthetic construct
  misc_feature 1..1876: note = mRNA product Design a-5 comprising derived and/or modified sequence from HRSV(A2)__F_DSCav1_mut2 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2420 - RNA, 1876 nt, synthetic construct
  misc_feature 1..1876: note = mRNA product Design a-5 comprising derived and/or modified sequence from HRSV(A2)__F_DSCav1_mut2 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2421 - RNA, 1876 nt, synthetic construct
  misc_feature 1..1876: note = mRNA product Design a-5 comprising derived and/or modified sequence from HRSV(A2)__F_DSCav1_mut2 (opt6)
  source 1..1876: mol_type = other RNA
gggagactttcccattctgtagcagaatttggtgttgcctgtggtcttggtcccgcggagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2422 - RNA, 1876 nt, synthetic construct
  misc_feature 1..1876: note = mRNA product Design a-5 comprising derived and/or modified sequence from HRSV(A2)__F_DSCav1_mut2 (opt11)
  source 1..1876: mol_type = other RNA
gggagactttcccattctgtagcagaatttggtgttgcctgtggtcttggtcccgcggagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2423 - RNA, 2057 nt, synthetic construct
  misc_feature 1..2057: note = mRNA product Design b-1 comprising derived and/or modified sequence from HRSV(A2)__F_DSCav1_mut2 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2424 - RNA, 2057 nt, synthetic construct
  misc_feature 1..2057: note = mRNA product Design b-1 comprising derived and/or modified sequence from HRSV(A2)__F_DSCav1_mut2 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2425 - RNA, 2057 nt, synthetic construct
  misc_feature 1..2057: note = mRNA product Design b-1 comprising derived and/or modified sequence from HRSV(A2)__F_DSCav1_mut2 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2426 - RNA, 2057 nt, synthetic construct
  misc_feature 1..2057: note = mRNA product Design b-1 comprising derived and/or modified sequence from HRSV(A2)__F_DSCav1_mut2 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2427 - RNA, 2057 nt, synthetic construct
  misc_feature 1..2057: note = mRNA product Design b-1 comprising derived and/or modified sequence from HRSV(A2)__F_DSCav1_mut2 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2428 - RNA, 2057 nt, synthetic construct
  misc_feature 1..2057: note = mRNA product Design b-1 comprising derived and/or modified sequence from HRSV(A2)__F_DSCav1_mut2 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2429 - RNA, 2057 nt, synthetic construct
  misc_feature 1..2057: note = mRNA product Design b-1 comprising derived and/or modified sequence from HRSV(A2)__F_DSCav1_mut2 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2430 - RNA, 2057 nt, synthetic construct
  misc_feature 1..2057: note = mRNA product Design b-1 comprising derived and/or modified sequence from HRSV(A2)__F_DSCav1_mut2 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2431 - RNA, 1877 nt, synthetic construct
  misc_feature 1..1877: note = mRNA product Design b-2 comprising derived and/or modified sequence from HRSV(A2)__F_DSCav1_mut2 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2432 - RNA, 1877 nt, synthetic construct
  misc_feature 1..1877: note = mRNA product Design b-2 comprising derived and/or modified sequence from HRSV(A2)__F_DSCav1_mut2 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2433 - RNA, 1877 nt, synthetic construct
  misc_feature 1..1877: note = mRNA product Design b-2 comprising derived and/or modified sequence from HRSV(A2)__F_DSCav1_mut2 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2434 - RNA, 1877 nt, synthetic construct
  misc_feature 1..1877: note = mRNA product Design b-2 comprising derived and/or modified sequence from HRSV(A2)__F_DSCav1_mut2 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2435 - RNA, 1877 nt, synthetic construct
  misc_feature 1..1877: note = mRNA product Design b-2 comprising derived and/or modified sequence from HRSV(A2)__F_DSCav1_mut2 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2436 - RNA, 1877 nt, synthetic construct
  misc_feature 1..1877: note = mRNA product Design b-2 comprising derived and/or modified sequence from HRSV(A2)__F_DSCav1_mut2 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2437 - RNA, 1877 nt, synthetic construct
  misc_feature 1..1877: note = mRNA product Design b-2 comprising derived and/or modified sequence from HRSV(A2)__F_DSCav1_mut2 (opt6)
  source 1..1877: mol_type = other RNA
gggagagcctctgctggagtccggggagtggcgttggctgctagagcgaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2438 - RNA, 1877 nt, synthetic construct
  misc_feature 1..1877: note = mRNA product Design b-2 comprising derived and/or modified sequence from HRSV(A2)__F_DSCav1_mut2 (opt11)
  source 1..1877: mol_type = other RNA
gggagagcctctgctggagtccggggagtggcgttggctgctagagcgaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2439 - RNA, 1897 nt, synthetic construct
  misc_feature 1..1897: note = mRNA product Design b-3 comprising derived and/or modified sequence from HRSV(A2)__F_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2440 - RNA, 1897 nt, synthetic construct
  misc_feature 1..1897: note = mRNA product Design b-3 comprising derived and/or modified sequence from HRSV(A2)__F_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2441 - RNA, 1897 nt, synthetic construct
  misc_feature 1..1897: note = mRNA product Design b-3 comprising derived and/or modified sequence from HRSV(A2)__F_DSCav1_mut2 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2442 - RNA, 1897 nt, synthetic construct
  misc_feature 1..1897: note = mRNA product Design b-3 comprising derived and/or modified sequence from HRSV(A2)__F_DSCav1_mut2 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2443 - RNA, 1897 nt, synthetic construct
  misc_feature 1..1897: note = mRNA product Design b-3 comprising derived and/or modified sequence from HRSV(A2)__F_DSCav1_mut2 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2444 - RNA, 1897 nt, synthetic construct
  misc_feature 1..1897: note = mRNA product Design b-3 comprising derived and/or modified sequence from HRSV(A2)__F_DSCav1_mut2 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2445 - RNA, 1897 nt, synthetic construct
  misc_feature 1..1897: note = mRNA product Design b-3 comprising derived and/or modified sequence from HRSV(A2)__F_DSCav1_mut2 (opt6)
  source 1..1897: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2446 - RNA, 1897 nt, synthetic construct
  misc_feature 1..1897: note = mRNA product Design b-3 comprising derived and/or modified sequence from HRSV(A2)__F_DSCav1_mut2 (opt11)
  source 1..1897: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2447 - RNA, 1948 nt, synthetic construct
  misc_feature 1..1948: note = mRNA product Design b-4 comprising derived and/or modified sequence from HRSV(A2)__F_DSCav1_mut2 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2448 - RNA, 1948 nt, synthetic construct
  misc_feature 1..1948: note = mRNA product Design b-4 comprising derived and/or modified sequence from HRSV(A2)__F_DSCav1_mut2 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2449 - RNA, 1948 nt, synthetic construct
  misc_feature 1..1948: note = mRNA product Design b-4 comprising derived and/or modified sequence from HRSV(A2)__F_DSCav1_mut2 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2450 - RNA, 1948 nt, synthetic construct
  misc_feature 1..1948: note = mRNA product Design b-4 comprising derived and/or modified sequence from HRSV(A2)__F_DSCav1_mut2 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2451 - RNA, 1948 nt, synthetic construct
  misc_feature 1..1948: note = mRNA product Design b-4 comprising derived and/or modified sequence from HRSV(A2)__F_DSCav1_mut2 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
